United States Patent
Weaver et al.

(10) Patent No.: US 10,279,031 B2
(45) Date of Patent: May 7, 2019

(54) COMPOSITION COMPRISING ANTIGENS AND A MUCOSAL ADJUVANT AND A METHOD FOR USING

(71) Applicant: Phibro Animal Health Corporation, Teaneck, NJ (US)

(72) Inventors: Grant Weaver, Kingsley, IA (US); Jeffrey Alan Kula, Lincoln, NE (US); Boh Chang Lin, Omaha, NE (US); Karen Brown, Parkville, MO (US); Wesley W. Johnson, Platte City, MO (US); Michael Dennis Murphy, Atlantic, IA (US)

(73) Assignee: Phibro Animal Health Corporation, Teaneck, NJ (US)

( * ) Notice: Subject to any disclaimer, the term of this patent is extended or adjusted under 35 U.S.C. 154(b) by 0 days.

(21) Appl. No.: 15/593,223

(22) Filed: May 11, 2017

(65) Prior Publication Data

US 2017/0326226 A1    Nov. 16, 2017

Related U.S. Application Data

(63) Continuation-in-part of application No. PCT/US2016/031902, filed on May 11, 2016.

(60) Provisional application No. 62/334,971, filed on May 11, 2016.

(51) Int. Cl.
*A61K 39/145* (2006.01)
*A61K 39/102* (2006.01)
*C12N 7/00* (2006.01)
*A61K 39/00* (2006.01)

(52) U.S. Cl.
CPC .......... *A61K 39/145* (2013.01); *A61K 39/102* (2013.01); *C12N 7/00* (2013.01); *A61K 2039/543* (2013.01); *A61K 2039/552* (2013.01); *A61K 2039/55511* (2013.01); *C12N 2760/16134* (2013.01)

(58) Field of Classification Search
None
See application file for complete search history.

(56) References Cited

U.S. PATENT DOCUMENTS

| | | | |
|---|---|---|---|
| 4,235,601 A | 11/1980 | Deutsch | |
| 4,562,147 A | 12/1985 | Joo | |
| 4,944,942 A | 7/1990 | Brown et al. | |
| 5,591,645 A | 1/1997 | Rosenstein | |
| 5,690,940 A | 11/1997 | Joo | |
| 5,888,513 A | 3/1999 | Plana Duran et al. | |
| 6,251,397 B1 | 6/2001 | Paul et al. | |
| 6,380,376 B1 | 4/2002 | Paul et al. | |
| 6,592,873 B1 | 7/2003 | Paul et al. | |
| 6,673,342 B1 | 1/2004 | Capra et al. | |
| 6,682,745 B1 | 1/2004 | Jacobs et al. | |
| 6,773,908 B1 | 10/2004 | Paul et al. | |
| 7,241,582 B2 | 7/2007 | Joo et al. | |
| 8,968,744 B2 * | 3/2015 | Mombarg | A61K 9/0019 424/184.1 |
| 2003/0064079 A1 * | 4/2003 | Goudie | A61K 39/0241 424/248.1 |
| 2003/0186225 A1 | 10/2003 | Paul et al. | |
| 2005/0220814 A1 | 10/2005 | Dominowski et al. | |
| 2006/0127885 A1 | 6/2006 | Kang et al. | |
| 2008/0019912 A1 | 1/2008 | Harris et al. | |
| 2009/0117152 A1 * | 5/2009 | Chu | A61K 39/0241 424/201.1 |
| 2011/0038900 A1 | 2/2011 | Chaprapani et al. | |
| 2013/0302370 A1 | 11/2013 | Fachinger et al. | |
| 2014/0004144 A1 | 1/2014 | Bey et al. | |
| 2014/0255442 A1 | 9/2014 | Burgard et al. | |
| 2017/0179594 A1 | 6/2017 | Liao et al. | |
| 2017/0326226 A1 * | 11/2017 | Weaver | A61K 39/145 |

FOREIGN PATENT DOCUMENTS

WO    WO 1996/006619    3/1996
WO    WO 1999/039582    8/1999
(Continued)

OTHER PUBLICATIONS

Shaikh et al. (Journal of Pharmacy and BioAllied Sciences. Jan.-Mar. 2011; 3 (1): 89-100).*

Cancel-Tirado et al., "Monoclonal antibody analysis of porcine reproductive and respiratory syndrome virus epitopes associated with antibody-dependent enhancement and neutralization of virus infection," *Veterinary Immunology and Immunopathology* 102:249-262, 2004.

Charerntantanakul et al., "Immune responses and protection by vaccine and various vaccine adjuvant candidates to virulent porcine reproductive and respiratory syndrome virus," *Veterinary Immunology and Immunopathology* 109(1-2):99-115, Feb. 2006.

(Continued)

*Primary Examiner* — Shanon A. Foley
(74) *Attorney, Agent, or Firm* — Klarquist Sparkman, LLP (57) ABSTRACT

The majority of the mortality observed in young pigs occurs between three and five weeks post-weaning for *S. suis* infections and between four and six weeks post-weaning for *H. parasuis* and *Actinobacillus suis* infections. Clinical disease control associated with *S. suis*, *A. suis* and *H. parasuis* has been attempted using antibiotic treatment, by controlled exposure with live organisms, and by vaccination, using either inactivated commercial or autogenous bacterins administered parenterally. A similar lack of protection in very young pigs is observed with various viruses including swine influenza virus, porcine reproductive and respiratory syndrome virus, porcine epidemic diarrhea virus and rotavirus. Disclosed herein is an immunogenic composition comprising inactivated antigens and a mucosal adjuvant. The composition may be administered to subjects, such as animals, particularly piglets from pre-weaning through the nursery phase, such as from birth or from three to five days of age, to protect from these diseases.

6 Claims, 5 Drawing Sheets
Specification includes a Sequence Listing.

(56) References Cited

FOREIGN PATENT DOCUMENTS

| WO | WO 2000/053787 | 9/2000 |
|----|----|----|
| WO | WO 2002/095040 | 11/2002 |

OTHER PUBLICATIONS

Cho et al., "An ELISA of Porcine Reproductive and Respiratory Syndrome: Production of Antigen of High Quality," *Canadian Journal of Veterinary Research* 60(2):89-93, May 1996.
Cho et al., "Performance of ELISA Antigens Prepared from 8 Isolates of Porcine Reproductive and Respiratory Syndrome Virus with Homologous and Heterologous Antisera," *Canadian Journal of Veterinary Research* 61(4):299-304, Oct. 1997.
Delputte et al., "Involvement of the Matrix Protein in Attachment of Porcine Reproductive and Respiratory Syndrome Virus to a Heparin-like Receptor on Porcine Alveolar Macrophages," *Journal of Virology* 76(9):4312-4320, May 2002.
Denac et al., "An indirect ELISA for the detection of antibodies against porcine reproductive and respiratory syndrome virus using recombinant nucleocapsid protein as antigen," *Journal of Virological Methods* 65(2):169-181, 1997.
Faaberg et al., "Neutralizing antibody responses of pigs infected with natural GP5 N-glycan mutants of porcine reproductive and respiratory syndrome virus," *Viral Immunology* 19(2):294-304, Summer 2006.
Fernandez et al., "Porcine reproductive and respiratory syndrome virus (PRRSV) envelope GP5 protein fails to protect pigs against PRRSV," $4^{th}$ *International Symposium on Emerging and Re-Emerging Pig Diseases*, Rome, Italy, Jun. 29-Jul. 2, 2003.
Gonin et al., "Seroneutralization of porcine reproductive and respiratory syndrome virus correlates with antibody response to the GP5 major envelope glycoprotein," *Journal of Veterinary Diagnostic Investigation* 11:20-26, 1999.
Meulenberg et al., "Localization and Fine Mapping of Antigenic Sites on the Nucleocapsid Protein N of Porcine Reproductive and Respiratory Syndrome Virus with Monoclonal Antibodies," *Virology* 252:106-114, 1998.

Nelson et al., "Serum immune responses to the proteins of porcine reproductive and respiratory syndrome (PRRS) virus," *Journal of Veterinary Diagnostic Investigation* 6:410-415, 1994.
Nielsen et al., "Reversion of a live porcine reproductive and respiratory syndrome virus vaccine investigated by parallel mutations," *Journal of General Virology* 82:1263-1272, 2001.
Ostrowski et al., "Identification of Neutralizing and Nonneutralizing Epitopes in the Porcine Reproductive and Respiratory Syndrome Virus GP5 Ectodomain," *Journal of Virology* 76(9):4241-4250, May 2002.
Pirzadeh et al., "Immune response in pigs vaccinated with plasmid DNA encoding ORF5 of porcine reproductive and respiratory syndrome virus," *Journal of General Virology* 79:989-999, 1998.
Plana-Duran et al., "New strategies on vaccinology: Use of the transmissible gastroenteritis virus as a vector for swine disease," $4^{th}$ *International Symposium on Emerging and Re-Emerging Pig Diseases*, Rome, Italy, Jun. 29-Jul. 2, 2003.
Rodriguez et al., "Identification of an immunodominant epitope in the C terminus of glycoprotein 5 of porcine reproductive and respiratory syndrome virus," *Journal of General Virology* 82:995-999, 2001.
Rogan et al., "Novel vaccines from biotechnology," *Revue Scientifique et Technique* (*International Office of Epizootics*) 24(1):159-174, 2005.
Wagner et al., "Protection against heterologous PRRSV challenge in pregnant sows immunized with multivalent PRRS vaccine," *International PRRS Symposium*, St. Louis, MO, Dec. 2-3, 2005.
Yeager, "The effect of vaccination with combinations of commercial PPRSV vaccines on the development of serum neutralizing antibodies to 6 antigenically different strains of PPRSV," *Research Report Swine Health* NPB #99-035, National Pork Board, Aug. 1, 2000.
Yoon et al., "Isolation of a cytopathic virus from weak pigs on farms with a history of swine infertility and respiratory syndrome," *Journal of Veterinary Diagnostic Investigation* 4(2):139-143, 1992.
Yoon et al., "A modified serum neutralization test for the detection of antibody to porcine reproductive and respiratory syndrome virus in swine sera," *Journal of Veterinary Diagnostic Investigation* 6(3):289-292, Jul. 1994.

\* cited by examiner

FIG. 1

Intranasal      Intramuscular 1   2   3        4   5   6

COMPOSITION COMPRISING ANTIGENS AND A MUCOSAL ADJUVANT AND A METHOD FOR USING

CROSS REFERENCE TO RELATED APPLICATION

This application is a continuation-in-part application of International Application No. PCT/US2016/031902, filed on May 11, 2016, and also claims priority to U.S. provisional patent application No. 62/334,971, filed on May 11, 2016. Both applications are incorporated herein by reference in their entireties.

FIELD

This disclosure relates to a composition comprising antigens and a mucoadhesive adjuvant, and methods of making and using the composition.

BACKGROUND

Major economic losses in commercial swine nursery facilities are caused by diseases spread via the respiratory route. These include Streptococcus suis-related infections, Actinobacillus suis-related infections, Haemophilus parasuis related to Glässer's, Disease, Mycoplasma infections caused by Mycoplasma hyorhinis or Mycoplasma hyosynoviae, Actinobacillus pleuropneumoniae-related infections, Pasteurella-related infections cause by Pasteurella multocida, infections caused by Bordetella bronchiseptica, Erysipelothrix rhusiopathiae, Salmonella spp. including Salmonella cholerasuis and Salmonella typhimurium, Escherichia coli, swine influenza viruses, porcine reproductive and respiratory syndrome viruses (PRRSv) and disease caused by porcine epidemic diarrhea virus (PEDV). The majority of the mortality observed in these young pigs occurs between three and five weeks post-weaning for S. suis infections and between four and six weeks post-weaning for H. parasuis infections.

S. suis produces signs and/or symptoms including meningitis, polyserositis, arthritis, myocarditis, pericarditis and abortion. H. parasuis often produces an acute septicemia that leads to death. Additionally, the latter is an important component in the Porcine Respiratory Disease Complex. A. suis and the Mycoplasma species are common respiratory diseases of pigs that are transmitted by nose-to-nose contact. M. hyopneumoniae and M. hyorhinis both produce significant respiratory disease, whereas M. hyosynoviae more commonly causes arthritis resulting in lameness. B. bronchiseptica also results in a respiratory disease that is called atrophic rhinitis. P. multocida is another organism associated with atrophic rhinitis and that is spread via mucous membranes. Swine influenza virus and PRRS also produce significant respiratory diseases in pigs. PRRS is also associated with a reproductive syndrome causing abortion. On the other hand, the Salmonella species, E. coli and PEDV cause intestinal diseases that result in diarrhea that can kill neonates and young very quickly.

Attempts have been made to control clinical disease associated with all of the bacterial species, including S. suis, H. parasuis and A. suis, by antibiotic treatment, by controlled exposure to live organisms, and by vaccination using inactivated, parenterally-injected bacterial vaccines (bacterins). A currently accepted strategy for protecting weaned pigs entering this stage of production involves vaccination using appropriate bacterins at the standard time of piglet processing followed by revaccination at weaning. Such vaccinations utilize inactivated antigens that are administered either intramuscularly or subcutaneously (parenteral).

In commercial settings, sows and gilts are often already exposed to the diseases for which their offspring, especially neonatal offspring, will be susceptible. When sows or gilts are seropositive because of previous exposure or vaccination, they transfer lactogenic antibodies to their neonatal offspring, which may protect the neonates for a period of time. Unfortunately, such maternal antibodies often interfere with the neonate being able to produce their own antibodies if they are vaccinated at too young an age with a parenteral vaccine. Parenteral vaccination mainly stimulates the development of IgG and IgM antibodies.

In 1989, pork producers in the United States developed the Pork Quality Assurance program, a producer education and certification program to reduce the risk of animal health product residues in pork. In 2007, this program was enhanced and became known as Pork Quality Assurance Plus (PQA Plus®). One of the aspects of this program is to reduce the use of parenteral injections, especially in young pigs, helping to ensure the safety of food products.

SUMMARY

The present disclosure describes embodiments of a composition comprising inactivated bacterial antigens and a mucosal adjuvant, such as a mucoadhesive adjuvant. The composition can be administered mucosally, such as intranasally, to animals, such as pigs, particularly neonates, to immunize them again against typical neonatal and nursery diseases. Mucosal, such as intranasal, administration of the composition may stimulate the production of IgA, a mucosal antibody which may overcome maternal antibody interference. In a commercial setting, the intranasal administration technique has several other distinct advantages when compared with traditional parenteral vaccination. Such advantages include ease of administration at processing, lessened risk of tissue loss due to needle use, and reduction of workload. Furthermore, the mucosal route may be less susceptible to maternal immunity interference.

Mucosal vaccination, such as intranasal vaccination, is used for non-inactivated antigens, such as administering a live virulent virus or bacteria, a live attenuated virus or bacteria, a modified live virus or bacteria, a live vectored viral or bacterial antigen, or a combination thereof. However, those viruses or bacteria (herein defined as live antigens) protect by causing either a low-level of infection or a replication in the animal, which stimulates an immune response. No inactivated or killed antigens have been delivered mucosally, including intranasally, to pigs and demonstrated to either stimulate an IgA response or produce a protective response. Such an intranasal method of immunizing pigs would also meet the requirements of the PQA.

Disclosed herein are embodiments of a composition comprising one or more inactivated antigens obtained from one or more bacterial strains and/or one or more viral, strains, subunits, recombinant proteins and/or peptides from bacterial or viral antigens, and a mucosal, such as a mucoadhesive, adjuvant. Inactivated antigens that may be included in such a composition are antigens from bacterial strains such as S. suis, H. parasuis, A. suis, M. hyorhinis, M. hyosynoviae, P. multocida, B. bronchiseptica, E. rhusiopathiae, S. cholerasuis, S. typhimurium, E. coli, C. perfringens, C. difficile, or combinations thereof; virus antigens that may be included in such compositions include but are not limited to swine influenza viruses, such as H1N1, H3N2, H1N2, H2N3, or a combination thereof; porcine rotavirus groups A, B and C; PRRS; and/or PEDV. In some embodiments, the composition comprises one or more inactivated antigens obtained from one or more bacterial strains, such as *S. suis, H. parasuis*, and/or *A. suis*, and a mucosal, such as a mucoadhesive, adjuvant. Other inactivated antigens that may be included in such a composition are *M. hyorhinis, M. hyosynoviae, P. multocida, B. bronchiseptica, E. rhusiopathiae, S. cholerasuis, S. typhimurium, E. coli, C. perfringens, C. difficile*, swine influenza viruses, porcine rotavirus groups A, B and C, PRRS, and/or PEDV.

Other disclosed embodiments include certain inactivated viral antigens such as inactivated swine influenza (SIV or IAV-S), inactivated Porcine Respiratory and Reproductive Syndrome Virus (PRRSv), inactivated Porcine Epidemic Diarrhea Virus (PEDV) and other viruses that may be spread by inhalation of the virus.

In some embodiments, the composition does not comprise a nanoparticle. In other embodiments, the composition does not comprise a nanoparticle that comprises one or more biodegradable polymers.

Also disclosed are embodiments of a method of administering the composition to a subject, particularly an animal, such as a pig. The composition may be formulated for mucosal administration to pigs, such as intranasal administration. Administration of the composition may induce an immune response in the subject. The immune response may comprise an increased IgA response compared to an animal not administered the composition. Mucosal administration may reduce the severity and incidence of disease when the animal is later challenged by exposure to live organisms. Adjuvants with mucoadhesive characteristics include, but are not limited to, polymers, such as those comprising Carbopols or acrylic acids (such as polyacrylic acids), such as Carbigen™ adjuvant; oil-in-water based adjuvants, such as Emulsigen® adjuvant; nanoparticles; or combinations thereof. The adjuvants may include immunostimulators, such as dimethyldioctadecyl ammonium bromide (DDA) or chloride (DDAC), pluronics, aluminum hydroxide, aluminum phosphate, and others known to persons of ordinary skill in the art.

Accordingly, disclosed embodiments concern an immunogenic composition comprising one or more strains of inactivated *S. suis*, one or more strains of inactivated *H. parasuis* and/or one or more strains of *A. suis*. The disease-producing organisms including one or more isolates or strains of *H. parasuis, A. suis* and/or *S. suis* may originally have been isolated from a diseased animal. The bacteria can be grown in culture media to appropriate titers, such as at least $10^5$ colony forming units/mL (CFU/mL), and then inactivated prior to incorporation into a vaccine for administering mucosally.

Additionally, certain embodiments of the composition stimulate an IgA response when administered intranasally to neonatal pigs. Without being bound to a particular theory, the IgA response may be able to overcome inhibition by maternal antibodies that are delivered to the neonate by the sow or gilt.

Certain disclosed embodiments include multivalent immunogenic compositions comprising a combination of antigens from at least two of *S. suis, H. parasuis*, and *A. suis* that have been inactivated with an acceptable inactivating agent and a mucosal, such as a mucoadhesive, adjuvant. The multivalent immunogenic composition may comprise antigens from all three organisms. The combination may be then administered to pigs via a mucosal route. One or more administrations may be performed to produce protection from disease. Acceptable inactivating agents for use with these antigens include, but are not limited to, formaldehyde, formalin, binary ethyleneimine, thimerosal, beta propiolactone, detergents such as NP40 and Triton X 100, and combinations thereof. Antigens may include whole culture bacteria, subunits that have been extracted or separated from the culture, antigens obtained from recombinant organisms other than *S. suis, H. parasuis* or *A. suis* but which protect against *S. suis, H. parasuis* or *A. suis* infection or challenge, or a combination thereof. Infection or challenge means that the animal suffers one or more clinical signs of the *S. suis, A. suis* or *H. parasuis* diseases when they have been exposed to these live organisms.

In specific embodiments, one or more of the *S. suis, A. suis* or *H. parasuis* antigens are present in the composition in an amount of from about $10^2$ to about $10^{10}$ CFU/mL. The composition may further include a suitable pharmaceutical carrier, such as a diluent, adjuvant, antimicrobial agent, preservative, inactivating agent, or combination thereof. Antimicrobial agents can include, but are not limited to, antibiotics such as gentamicin, penicillin, neomycin, polymyxin B and mycostatin.

Also disclosed herein are embodiments of a method for reducing the incidence or lessening the severity of clinical signs associated with or caused by bacterial infections, such as infection by *S. suis, A. suis* and/or *H. parasuis*. In some embodiments, the method comprises reducing the incidence or lessening the severity of clinical signs associated with or caused by additional bacterial infections, such as infection by *M. hyorhinis, M. hyosynoviae, P. multocida, B. bronchiseptica, E. rhusiopathiae, S. cholerasuis, S. typhimurium, E. coli*, swine influenza viruses, PRRS, or PEDV comprising administering the composition to a subject, such as a pig, via a mucosal, such as intranasal, route. And embodiments of a method of vaccinating swine against diseases of *S. suis, H. parasuis, A. suis, M. hyorhinis, M. hyosynoviae, P. multocida, B. bronchiseptica, E. rhusiopathiae, S. cholerasuis, S. typhimurium, E. coli*, swine influenza viruses, PRRS, PEDV, or a combination thereof, by administering inactivated antigens of *S. suis, H. parasuis, A. suis, M. hyorhinis, M. hyosynoviae, P. multocida, B. bronchiseptica, E. rhusiopathiae, S. cholerasuis, S. typhimurium, E. coli*, swine influenza viruses, PRRS, PEDV or a combination thereof, to a subject, such as a pig, by an intranasal route, are also disclosed.

The foregoing and other objects, features, and advantages of the invention will become more apparent from the following detailed description, which proceeds with reference to the accompanying figures.

SEQUENCE LISTING

The nucleic and amino acid sequences listed in the accompanying sequence listing are shown using standard letter abbreviations for nucleotide bases, and three letter code for amino acids, as defined in 37 C.F.R. § 1.822. Only one strand of each nucleic acid sequence is shown, but the complementary strand is understood as included by any reference to the displayed strand. The Sequence Listing is submitted as an ASCII text file, created on May 11, 2017, 20 MB, which is incorporated by reference herein.

DETAILED DESCRIPTION

I. Definitions

The following explanations of terms and methods are provided to better describe the present disclosure and to guide those of ordinary skill in the art in the practice of the present disclosure. The singular forms "a," "an," and "the" refer to one or more than one, unless the context clearly dictates otherwise. The term "or" refers to a single element of stated alternative elements or a combination of two or more elements, unless the context clearly indicates otherwise. As used herein, "comprises" means "includes." Thus, "comprising A or B," means "including A, B, or A and B," without excluding additional elements. All references, including patents and patent applications cited herein, are incorporated by reference.

Unless otherwise indicated, all numbers expressing quantities of components, molecular weights, percentages, temperatures, times, and so forth, as used in the specification or claims are to be understood as being modified by the term "about." Accordingly, unless otherwise indicated, implicitly or explicitly, the numerical parameters set forth are approximations that may depend on the desired properties sought and/or limits of detection under standard test conditions/methods. When directly and explicitly distinguishing embodiments from discussed prior art, the embodiment numbers are not approximates unless the word "about" is recited.

Unless explained otherwise, all technical and scientific terms used herein have the same meaning as commonly understood to one of ordinary skill in the art to which this disclosure belongs. Although methods and materials similar or equivalent to those described herein can be used in the practice or testing of the present disclosure, suitable methods and materials are described below. The materials, methods, and examples are illustrative only and not intended to be limiting.

The term "adjuvant" as used herein means any component added to a vaccine that enhances the immune response and includes any adjuvant suitable for administration to an animal subject. In some embodiments, the adjuvant is, or comprises, a carbomer-based or carbopol-based polymer, such as Carbigen™ adjuvant (MVP adjuvants, a Division of Phibro Animal Health, Omaha, Nebr., USA), HRA-3, and HRA-5; an aluminum salt, such as aluminum hydroxide or aluminum phosphate; a saponin such as Quil A® adjuvant or Stimulon™ adjuvant QS-21 (Antigenics, Framingham, Mass.); an oil-in-water adjuvant such as an Emulsigen® adjuvant (MVP adjuvants, a Division of Phibro Animal Health Corporation, Omaha, Nebr., USA) containing a non-metabolizable oil, paraffin oil, mineral and/or plant/vegetable and/or animal oils; a surfactant; a lipid; nanoparticles including but not limited to oil-in-water based nanoparticles; cholesterol; water-in-oil emulsions; water-in-oil-in water emulsions; dimethyldioctadecyl ammonium bromide; dimethyldioctadecyl ammonium chloride; or combinations thereof. In adjuvants comprising emulsions, the emulsion can be based in particular on light liquid paraffin oil, isoprenoid oil such as squalane or squalene, oil resulting from the oligomerization of alkenes, in particular of isobutene or decene, esters of acids or of alcohols containing a linear alkyl group, more particularly plant oils, ethyl oleate, propylene glycol di-(caprylate/caprate), glyceryl tri-(caprylate/caprate) or propylene glycol dioleate, esters of branched fatty acids or alcohols, in particular isostearic acid esters. The oil may be used in combination with emulsifiers to form the emulsion. The emulsifiers are preferably non-ionic surfactants, in particular esters of sorbitan, of mannide, of glycol, of polyglycerol, of propylene glycol and of oleic, isostearic, ricinoleic or hydroxystearic acid, which are optionally ethoxylated, and polyoxypropylene-polyoxyethylene copolymer blocks, in particular the Pluronic products. In a preferred embodiment of the composition, the adjuvant is at a concentration of from 0.01% to 70%, such as from 1% to 50%, 1% to 30%, 5% to 20%, 7% to 20%, or 10% to 20% by volume of the final product.

Bacterial antigens suitable for use in the present technology include proteins, polysaccharides, lipopolysaccharides, and/or outer membrane vesicles which may be purified, isolated or derived from a bacterium. Bacterial antigens also may include bacterial lysates and inactivated bacteria formulations. In some embodiments, bacteria antigens may be produced by recombinant expression. Typically, bacterial antigens include epitopes which are exposed on the surface of the bacteria during at least one stage of a life cycle. Bacterial antigens may be conserved across multiple serotypes. Bacterial antigens include antigens derived from one or more of the bacteria disclosed herein.

Viral antigens suitable for use in the present technology include inactivated (or killed) virus and/or viral proteins which may be isolated, purified or derived from a virus. Viral antigens can be derived from viruses propagated on a substrate, such as a cell culture or other substrate, or they may be derived or expressed recombinantly. Typically, viral antigens include epitopes which are exposed on the surface of the virus during at least one stage of a life cycle. Viral antigens may be conserved across multiple serotypes or isolates. Viral antigens include antigens derived from one or more of the viruses disclosed herein.

The terms "mucoadhesive," "mucosal adjuvant," or "mucosally-adjuvanted" refer to an adjuvant that has the capability to adhere to mucosal membranes and stimulate an immune response. Mucous membranes include the nasopharyngeal, oral, optic (eye), vaginal or anal membranes. The immune response that is stimulated may include IgA, IgG, IgM, or a combination thereof, which are found in the serum and in mucosal washings. Compositions comprising such adjuvants are applied to the mucosal membranes of animals. Specific adjuvants with mucoadhesive characteristics include, but are not limited to, adjuvants comprising polymers, such as those comprising polyacrylic acids such as Carbopols or Carbomers (e.g. Carbigen™ adjuvant, HRA-3, HRA-5, Carbigen-M, Carbigen-P, or combinations thereof); or oil-in-water based adjuvants, such as Emulsigen® adjuvant, Emulsigen®-D adjuvant, Emulsigen®-DL90 adjuvant, Emulsigen®-BCL adjuvant, Emulsigen®-P adjuvant, Emulsigen®-M adjuvant, and combinations thereof. Additionally, adjuvants containing nanoparticles can be used for intranasal administration. A person of ordinary skill in the art understands that a mucoadhesive adjuvant could contain any combination of the above adjuvants as well. Acceptable mucoadhesive adjuvants also include any adjuvant that when administered mucosally, such as intranasally, stimulates an IgA response in pigs and/or protects pigs from challenge with a live organism.

Formulations for mucosal administration, including intranasal formulations, may comprise vehicles that neither cause irritation to the nasal mucosa nor significantly disturb ciliary function. Diluents such as water, aqueous saline, phosphate buffered saline (PBS), culture medias, or other known substances can be used in combination with other components of disclosed compositions. The nasal formulations may also contain preservatives such as, but not limited to, gentamicin, formaldehyde, formalin, thimerosal, binaryethyleneimine, and/or beta propiolactone, and/or may contain neutralizing agents such as sodium thiosulfate and/or sodium bisulfite. A surfactant may be present to enhance absorption of the subject proteins by the nasal mucosa. Acceptable surfactants include but are not limited to tweens, spans and detergents such as NP40 and Triton X 100.

Acceptable inactivating agents for inactivating bacterial antigens, such as S. suis, A. suis and/or H. parasuis antigens, or viral antigens such as SIV (IAV-S), PRRS and PEDV, include, but are not limited to, formaldehyde, formalin, binary ethyleneimine, thimerosal, beta-propiolactone, and combinations thereof.

Infection or challenge means that the subject has been exposed to live organisms that may produce disease causing the subject to suffer one or more clinical signs of the diseases when they have been exposed to these live organisms.

The term "effective amount" or "therapeutically effective amount" refers to the amount of an active agent (such as one or more embodiments provided herein alone, in combination, or potentially in combination with other therapeutic agent(s)) sufficient to induce a desired biological result. That result may be amelioration or alleviation of the signs, symptoms, or causes of a disease, or any other desired alteration of a biological system. The term "effective amount" or "therapeutically effective amount" is used herein to denote any amount of a therapeutic and/or preventative that causes an improvement in a disease condition, or prevention of disease symptoms. The amount can vary with the condition being treated, the stage of advancement of the condition, and the type and concentration of formulation applied. Appropriate amounts in any given instance will be readily apparent to those of ordinary skill in the art or capable of determination by routine experimentation such as vaccination and observation of an antibody response or vaccination followed by a challenge wherein the vaccinated animals perform better than non-vaccinated animals that are challenged similarly.

II. Composition

Disclosed herein are embodiments of a composition comprising one or more inactivated antigens and an adjuvant, such as a mucoadhesive adjuvant. The antigens may be any suitable antigen, but certain embodiments particularly may be obtained from one or more bacterial strains, particularly strains of S. suis, A. suis and/or H. parasuis and/or one or more viruses such as SIV (IAV-S), PRRSv and PEDV. The composition may be formulated for mucosal administration to a subject to stimulate an immune response, the response helping to reduce the severity and incidence of disease when the subject is later challenged by exposure to live organisms. The subject may be a human or an animal. The term "animal" refers to a non-human animal. The animal may be a mammal, such as a swine or pig. The immune response may comprise an IgA immune response.

In some embodiments, the composition comprises inactivated antigens from one or more S. suis strains or serovars, such as from 1, 2, 3, 4, 5, 6, 7, 8, 9, 10 or more S. suis strains or serovars. In some embodiments, the composition comprises inactivated antigens from one or more H. parasuis strains or serovars, such as from 1, 2, 3, 4, 5, 6, 7, 8, 9, 10 or more H. parasuis strains or serovars. In some embodiments, the composition comprises inactivated antigens from one or more A. suis strains or serovars, such as from 1, 2, 3, 4, 5, 6, 7, 8, 9, 10 or more A. suis strains or serovars. The composition may comprise inactivated antigens from one or more S. suis strains or serovars and one or more H. parasuis strains or serovars; inactivated antigens from one or more A. suis strains or serovars and one or more H. parasuis strains or serovars; inactivated antigens from one or more S. suis strains or serovars and one or more A. suis strains or serovars, or inactivated antigens from one or more S. suis strains or serovars, one or more H. parasuis strains or serovars, and one or more A. suis strains or serovars.

In some embodiments, the one or more antigens from S. suis comprise one or more antigens from serovars ½, 2, or 3. Additionally, or alternatively, the composition may comprise one or more antigens having at least a 85% sequence identity (i.e., 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to any strain and/or serovar of S. suis currently known or later discovered or developed, such as, but not limited to, strains identified by the GenBank Accession numbers AM946016.1, FM252031.1, or NC_012926.1, and/or by SEQ ID NO: 1, SEQ ID NO: 2, or SEQ ID NO: 3, and particularly to serovars ½, 2, or 3. In some embodiments, the one or more antigens from H. parasuis comprise one or more antigens from serovars 2 or 7. Additionally, or alternatively, the composition may comprise one or more antigens having at least a 85% sequence identity (i.e., 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to any strain and/or serovar of H. parasuis currently known or later discovered or developed, such as, but not limited to, strains identified by the GenBank Accession numbers NZ_CP015099.1, NZ_CP009237.1, or NZ_CP009158.1, and/or by SEQ ID NO: 4, SEQ ID NO: 5, or SEQ ID NO: 6, and particularly serovars 2, or 7. In some embodiments, the one or more antigens from A. suis comprise one or more antigens having at least a 85% sequence identity (i.e., 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to any strain and/or serovar of A. suis currently known or later discovered or developed, such as, but not limited to, the strain identified by the GenBank Accession number NZ_CP009159.1 and/or by SEQ ID NO: 7.

In some embodiments, the one or more antigens from SIV may comprise one or more antigens having at least a 85% sequence identity (i.e., 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to any strain of SIV, such as, but not limited to, identified by GenBank Accession numbers M81707, KC676310.1, AF222769, JQ783083.1, KU942624.1, AF268128, AF268124, KP788773.1, KU229931, CY158137, and/or by SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, or SEQ ID NO: 17. In some embodiments, the one or more antigens from PEDV may comprise one or more antigens having at least a 85% sequence identity (i.e., 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to any strain of PEDV, such as, but not limited to, SEQ ID NO: 18, SEQ ID NO: 19, SEQ ID NO: 20, SEQ ID NO: 21, SEQ ID NO: 22, SEQ ID NO: 23, SEQ ID NO: 24, or SEQ ID NO: 25. In some embodiments, the one or more antigens from PRRSV may comprise one or more antigens having at least a 85% sequence identity (i.e., 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or 100%) to any strain of PRRSV, such as, but not limited to, SEQ ID NO: 26, SEQ ID NO: 27, SEQ ID NO: 28, SEQ ID NO: 29, or SEQ ID NO: 30.

In some embodiments, the inactivated antigens include, but are not limited to, whole culture bacteria; subunits obtained from the *S. suis, A. suis* and/or *H. parasuis*, and/or from any other bacteria or virus that may be included, that have been extracted or separated from the culture; subunits that have been extracted or separated from the cells; antigens obtained from recombinant organisms other than *S. suis, A. suis* or *H. parasuis* but which protect against *S. suis, A. suis* or *H. parasuis* infection or challenge; or combinations thereof. Such antigens may also be combined with other antigens that are typically administered to subjects, such as pigs, particularly neonatal pigs. Such additional antigens include, but are not limited to, antigens from *M. hyorhinis, M. hyosynoviae, P. multocida, B. bronchiseptica, E. rhusiopathiae, S. cholerasuis, S. typhimurium, E. coli, C. perfringens, C. difficile*, porcine rotaviruses swine influenza virus (swine influenza virus, SIV), porcine reproductive and respiratory syndrome virus (PRRSv), porcine epidemic diarrhea virus (PEDv), porcine parvo virus, or a combination thereof, and/or others known to persons of ordinary skill in the art.

In some embodiments, the inactivated antigens include, but are not limited to, whole culture viruses; subunits or recombinants obtained from SIV (IAV-S), PRRSv, PEDV and/or from any other virus that may be included, that have been extracted or separated from the culture; subunits that have been extracted or separated from the cells; antigens obtained from recombinant organisms other than SIV (IAV-S), PRRSv and PEDV but which protect against swine influenza, PRRSv or PEDV infection or challenge; or combinations thereof. Such antigens may also be combined with other antigens that are typically administered to subjects, such as pigs, particularly neonatal pigs. Such additional antigens include, but are not limited to, antigens from porcine rotaviruses, porcine parvo virus, or a combination thereof, and/or others known to persons of ordinary skill in the art or any bacterial antigens such as *M. hyorhinis, M. hyosynoviae, P. multocida, B. bronchiseptica, E. rhusiopathiae, S. cholerasuis, S. typhimurium, E. coli, C. perfringens, C. difficile*, or a combination thereof.

In some embodiments, the composition does not comprise a nanoparticle. In some embodiments, the composition does not comprise a nanoparticle that comprises one or more biodegradable polymers.

In some embodiments, administering the composition mucosally, such as intranasally, to a neonatal pig results in an IgA immune response that also may help to overcome maternal antibodies that the piglet may receive from a sow or gilt that is positive for *S. suis, H. parasuis, A. suis*, SIV (IAV-S), PRRSv, PEDV, rotavirus or any other bacteria or virus. If the neonatal pig receives maternal antibodies and then receives a parenteral vaccination, the maternal antibodies often block the neonate from developing its own protective antibodies. The method of mucosal vaccination, such as intranasal, administration described herein may produce an IgA response that can help overcome the maternal antibodies transferred to neonates.

Immunogenic compositions for mucosal administration, such as intranasal administration, have several advantages over compositions that are administered by other routes, such as the intramuscular or subcutaneous routes. The advantages include, but are not limited to: 1) protecting the neonatal pigs using humane techniques; 2) not exposing the neonate to stressful needle injections; 3) not involving injecting the neonates with live or modified live organisms that can shed and spread disease; 4) allowing the neonate to develop IgA antibodies that can overcome maternal IgG antibodies transferred from the sow or gilt; 5) not leaving any injection site lesions and thus allowing a zero day withdrawal time; 6) being easier to administer and reducing the workload; 7) reducing or substantially eliminating the risk of accidental self-injection of the worker; and/or 8) being able to be administered in the face of an outbreak to stop disease spread in a herd. Other advantages may be apparent from the description and the example section below.

Embodiments of the composition may be able to provide better protection against diseases caused by *S. suis, A. suis, H. parasuis*, SIV (IAV-S), PRRSv, PEDV, rotavirus, and similar organisms that cause infections through the respiratory tract, following revaccination or additional administration of an immunogenic composition. The revaccination or additional administration may be delivered via the intranasal route or by a parenteral route such as intramuscular, subcutaneous or intravenous. Furthermore, the disclosed composition may also be able to overcome maternal antibody inhibition of piglet antibody production, thus providing a greater protection of neonatal pigs throughout their development, compared to neonatal pigs that are not administered the disclosed composition.

Some embodiments of the disclosed composition are able to induce protective levels of antibodies as measured by the ELISA in >50%, typically in >80% of the individuals that are administered the composition. In some embodiments, the mucoadhesive composition also is able to maintain protective levels of antibodies against the *S. suis, A. suis, H. parasuis*, SIV (IAV-S), PRRSv, PEDV and/or rotavirus strains throughout the piglet growth phase from the neonatal or pre-weaning phase through the nursery phase, which is typically from weaning at about 21 days of age to about 10 weeks of age. Thus, in certain embodiments, the composition can produce a persistent immune response against *S. suis, A. suis, H. parasuis*, SIV (IAV-S), PRRSv, PEDV and/or related diseases. As used herein, a "persistent immune response" refers to a protective antibody immune response which is capable of protecting the pigs throughout their growth period in the nursery.

Embodiments of the immunogenic composition that comprise one or more strains of inactivated *S. suis, A. suis* and/or inactivated *H. parasuis*, that are each independently grown to titers greater than $10^2$ CFU/mL, preferably greater than $10^5$ CFU/mL, and more preferably greater than $10^7$ CFU/mL, induce high titers of IgA antibodies in neonatal pigs. Such IgA titers measured in serum will be at least 50 ELISA units, preferably greater than 100 ELISA units.

Additional embodiments of the immunogenic composition that comprise one or more strains of inactivated SIV (IAV-S), including but not limited to H1N1 and H3N2, PRRSv, PEDV, and/or inactivated rotavirus, that are each independently grown to titers greater than $10^2$ TCID$_{50}$/mL, preferably greater than $10^5$ TCID$_{50}$/mL, induce high titers of IgA antibodies in neonatal pigs. Such IgA titers measured in mucosal washings or in serum will be at least 10 ELISA units, preferably greater than 50 ELISA units.

Figure 1:
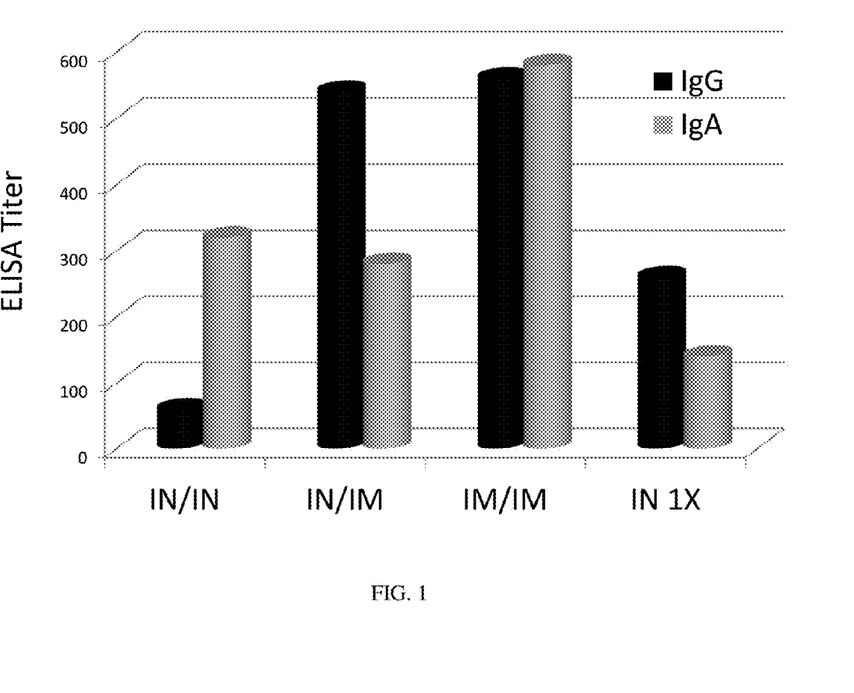
FIG. 1 is a graph of ELISA titer versus administration protocol, illustrating the measured IgA and IgG serum levels resulting from the various administration protocols, establishing that intranasal administration resulted in the production of IgA and IgG antibodies in the pigs.
Figure 2:
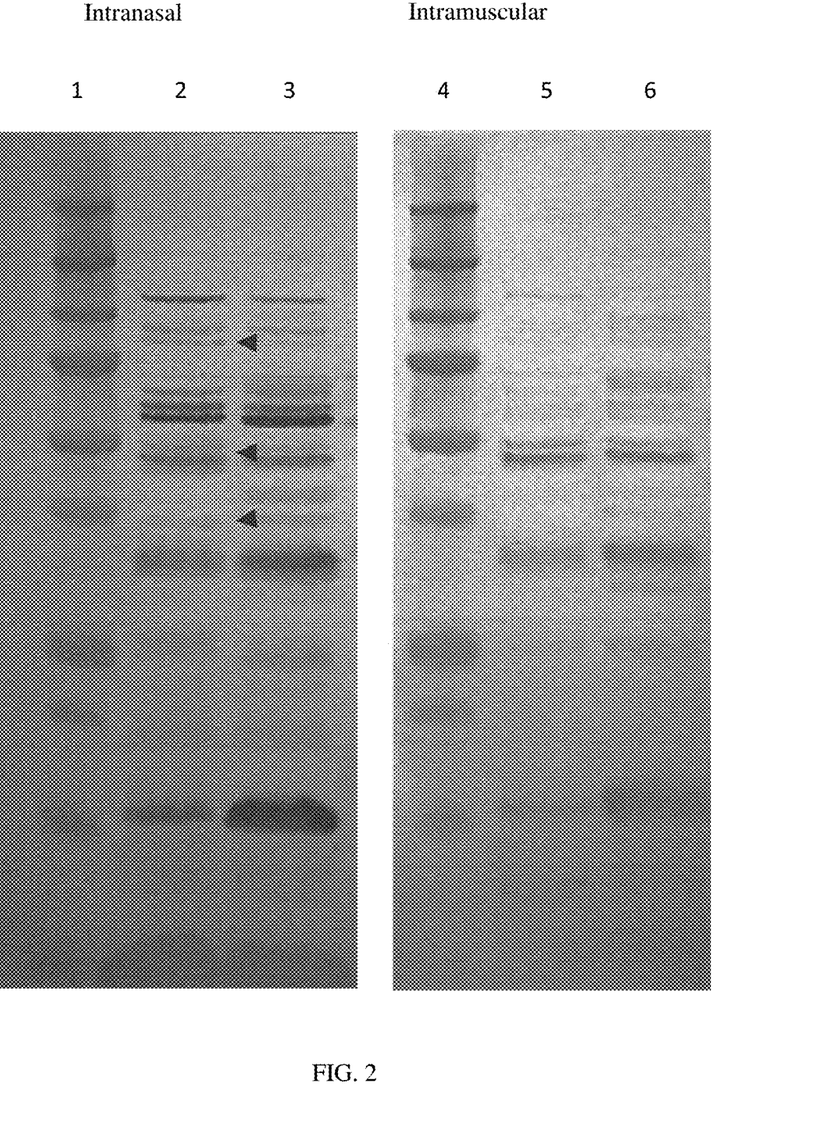
FIG. 2 is a Western Blot of *H. parasuis* antigens, comparing pig antibody responses produced by intranasal (lanes 1, 2, and 3) or intramuscular (lanes 4, 5, and 6) vaccination with a combination of inactivated *H. parasuis, A. suis*, and *S. suis*, establishing that intranasal administration resulted in protective antibody production in the pig.
Figure 3:
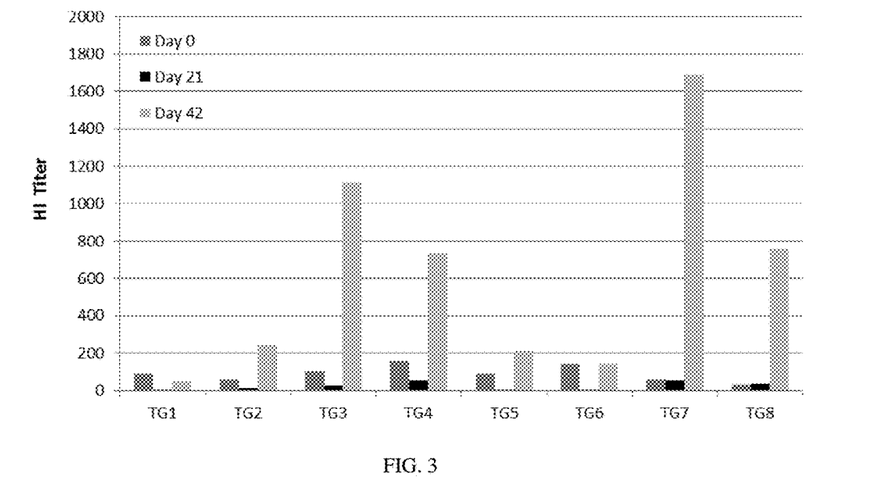
FIG. 3 is a graph of Hemagglutination inhibition (HI) titer versus treatment group (TG), illustrating the HI titers by treatment group for H1N1 swine influenza virus in Example 6.
Figure 4:
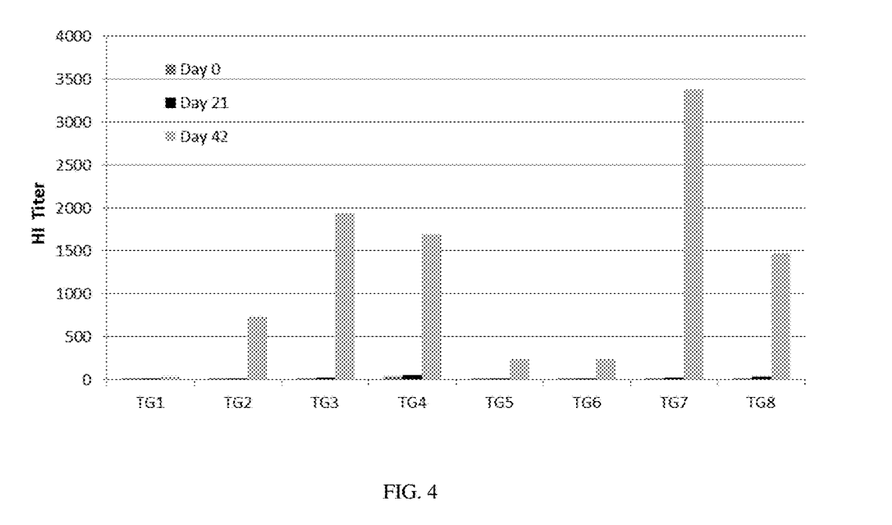
FIG. 4 is a graph of HI titer versus treatment group, illustrating the HI titers by treatment group for H3N2 swine influenza virus in Example 6.

Surprisingly, embodiments of the disclosed immunogenic composition, when delivered to neonatal pigs via the mucosal route, such as an intranasal route, also induced serum IgG responses as demonstrated in the piglets (see FIGS. 1 and 2 and Table 2). In some embodiments, such titers are from 0 to 50 ELISA units, but in other embodiments, the titers are greater than 50 ELISA units. It is expected that a mucosal IgA response will be measurable prior to the serum IgA response.

In some embodiments, the immunogenic composition comprises one or more strains or isolates of inactivated *S. suis*, one or more strains or isolates of *A. suis*, one or more strains or isolates of *H. parasuis*, one or more strains or subtypes of SIV (IAV-S), one or more isolates or groups of PRRSv, one or more isolates of PEDV and/or one or more isolates or types of rotaviruses which have been isolated from infected pigs. In such embodiments, the strains may not have been passaged in artificial culture (in vitro) more than 20 times. Preferably, the one or more strains of *S. suis, A. suis, H. parasuis* SIV (IAV-S), PRRSv, PEDV and/or rotavirus would not be passaged more than 10 times in vitro.

In some embodiments, the immunogenic composition is an inactivated vaccine.

The composition may be administered to a subject, such as a pig, of any age. In some embodiments, the initial administration is to pigs of from birth to 10 days of age, such as from one to ten days of age, from one to five days of age, or from one to three days of age. One or more additional administrations of a composition comprising one or more inactivated antigens obtained from one or more strains of *S. suis, A. suis, H. parasuis*, SIV (IAV-S), PRRSv, PEDV, and/or rotavirus may be necessary in two to six weeks from the initial administration of the disclosed composition. This second administration may be delivered parenterally and may include non-mucoadhesive adjuvants. Any additional administrations may be administered via a mucosal route, such as intranasal, or any other route that is preferred by the administrator. For instance, the additional administrations may be mucosal such as intranasal, intramuscular, subcutaneous, intraperitoneal, intravenous, or a combination thereof.

III. Examples

Example 1—Composition Preparation

Two compositions were prepared for vaccination of neonates farrowed to sows in the farm described in Example 2. The object was to determine whether intranasal administration of the disclosed composition to neonates within the first five days of life would help to reduce morbidity and mortality among the pigs. Multiple isolates of *S. suis* (serovars ½, 2, and 3) and *H. parasuis* (serovars 2, 7, and non-typeable) and one isolate of *A. suis* were identified and found to be responsible for causing clinical disease and mortality in the nursery pigs. Bacterins (inactivated bacterial vaccines) were prepared by growing all of the isolates in vitro to titers >$10^5$ CFU/mL. Each isolate was inactivated with 0.1% formalin after which isolates were pooled in equal amounts. After pooling, the pool was split into two equal aliquots. One aliquot was first adjuvanted with 4% aluminum hydroxide. This was followed by adding an oil-in-water adjuvant called Emulsigen® at 12% v/v. The second aliquot was adjuvanted with 10% Carbigen™, a mucoadhesive polyacrylic acid adjuvant.

Example 2—Experimental Design

A commercial sow farm of 2,000 sows experiencing significant nursery mortality from *S. suis, A. suis* and/or *H. parasuis* infection was selected for evaluation of the different administration routes/regimens of piglets. Nursery pigs from this source were also positive for porcine reproductive and respiratory syndrome virus (PRRS), porcine circovirus type 2 (PCV2), swine influenza A (IAV-S), and *M. hyopneumoniae*. Pigs were weaned at 21 days of age and transferred to a single-source, off-site nursery. The nursery contained four rooms which were filled with approximately 900 pigs each. When clinical disease occurred in the nursery, individual animals were given an antibiotic injection. No feed or mass water medications were administered.

Neonatal piglets were enrolled at the sow farm into the study over five consecutive weeks of farrowing. Administration occurred at the time of processing which was between the third and fifth day post farrowing. The piglets were randomly assigned to one of four groups by colored ear tags. The groups are shown in Table 1 and were:

1) intranasal (IN) administration at processing and repeated at weaning (about 21 days of age);

2) IN administration at processing and intramuscular (IM) injection at weaning;

3) IM administration at processing and repeated at weaning; and

4) IN administration at processing only (a single administration of the composition).

Piglets within litters were placed in different groups so as to equally represent each of the four treatment groups as much as possible. At weaning, treatment groups of pigs were not sorted to separate pens. The animals were randomly mixed together in order to promote uniform exposure to pathogens.

TABLE 1

Administration adjuvants and regimes

| Group No. | Adjuvant | Routes of Administration | Dose Size (mL) | No. of Doses | No. of Piglets | Age at administration (Days) |
|---|---|---|---|---|---|---|
| 1 | Carbigen ™ | IN/IN | 2.0 | 2 | 911 | 3-5/21 |
| 2 | Carbigen ™/Emulsigen ® + Aluminum hydroxide | IN/IM | 1.0/2.0 | 2 | 911 | 3-5/21 |
| 3 | Emulsigen ® + Aluminum hydroxide | IM/IM | 2.0/2.0 | 2 | 929 | 3-5/21 |
| 4 | Carbigen ™ | IN | 1.0 | 1 | 848 | 3-5 |

Example 3—Laboratory Testing

From pigs in the week 3 production group, 10 serum samples were randomly collected from each of the four treatment groups at approximately three weeks after the weaning administrations. The samples were analyzed by homologous ELISA using soluble proteins obtained from the *H. parasuis* vaccine strains as coated antigens in an assay method described by Lin, B. et al. "Antibody response of young pigs to autogeneous *Haemophilus parasuis* vaccine," AASV 2007:207. IgA and IgG in serum samples were measured and are shown in Table 2 and FIG. 1.

The majority of animals in each of the treatment groups in this investigation responded with measurable ELISA IgA titers to *H. parasuis* (vaccine strain) indicating that the pigs had largely (>80%) seroconverted. The IN/IM and IM/IM groups were the only treatments that resulted in >80% rate of seroconversion as measured by IgG titer. Surprisingly, the IN groups developed significant IgG ELISA titers in the serum.

TABLE 2

IgA and IgG Antibody responses post administration

| Group No. | Routes of Administration | Antibody Response to *H. parasuis* as measured by ELISA | |
|---|---|---|---|
| | | IgA | IgG |
| 1 | IN/IN | 320 | 60 |
| 2 | IN/IM | 220 | 540 |
| 3 | IM/IM | 580 | 560 |
| 4 | IN Single Dose | 140 | 260 |

Example 4—Western Blot Analysis of Antibody Response to Antigens of *H. Parasuis*

Blood samples were obtained randomly from 10 pigs in each of the IN/IN and IM/IM groups of pigs from Example 2. Equal aliquots were pooled and were used in a Western Blot analysis to evaluate the antibody responses of pigs to antigens of *H. parasuis* known to be important for protection. FIG. 2 provides the Western Blot for the IN/IN and IM/IM groups, with lanes 1, 2 and 3 representing the IN/IN group, and lanes 4, 5 and 6 representing the IM/IM group. Lanes 1 and 4 are molecular weight markers (Bio-Rad #161-0373); lanes 2 and 5 are loaded with 20 ug/well of Hps #32575; and lanes 3 and 6 are loaded with 20 ug/well of Hps #31136.

The Western Blot analysis demonstrated that the IN/IN group of pigs developed significant antibody responses to all of the important protective antigens of both *H. parasuis* strains that were included in the inactivated vaccine that they received (FIG. 2). From top to bottom, the arrows in FIG. 2 indicate the presence of the bands at 82 kD (neurimidase), 48 kD (P2 adhesion protein) and the 35 kD outer membrane protein, illustrating the presence of important antigens in the IN/IN group. Surprisingly, the IN/IN group developed stronger antibody responses than the pigs in the IM/IM group.

Example 5—Results of Herd Administration

Over the five weeks of study observation, the parameters recorded were pre-weaning mortality, percent nursery mortality, percent treated animals (antibiotic injected upon presence of clinical disease), and the percent poor quality pigs at the end of the nursery phase.

Data collected by treatment group for production week one through four were statistically analyzed. The week of production was used as the experimental unit. Main effects ANOVA was performed with percent nursery mortality, total percent mortality (pre-weaning mortality plus nursery mortality), percent treated animals, and percent poor quality pigs as the dependent variables and administration treatment as the independent variable.

As noted in Table 3, during the nursery phase the IN/IN and IN/IM groups had average mortality of 3.70% (s.d. 2.77%) and 9.13% (s.d. 6.67%), respectively. The average mortality observed in the IM/IM group was 5.03% (s.d. 3.49%) whereas the average mortality observed in the IN single dose (only once at processing) group was 1.42% (s.d. 1.79%). Statistical analysis indicated that across treatments, the type of administration did not significantly affect the mortality rate in the nursery (p>0.05). However, there is a strong indication that the single intranasal vaccination produced the best result with the IN/IN vaccination regimen producing the second best result.

TABLE 3

Average mortality during the nursery phase

| Group No. | Routes of Administration | Percent Mortality | Standard Deviation |
|---|---|---|---|
| 1 | IN/IN | 3.70 | 2.77 |
| 2 | IN/IM | 9.13 | 6.67 |
| 3 | IM/IM | 5.03 | 3.09 |
| 4 | IN (single dose) | 1.42 | 1.79 |

For total mortality (Table 4) which included both the pre-weaning and nursery mortality observed, the IN/IN and IN/IM groups had average mortality of 12.7% (s.d. 2.61%) and 14.5% (s.d. 7.68%), respectively. The IM/IM group was 12% (s.d. 3.67%) whereas the average total mortality observed in the IN (single dose at processing age of 3-5 days) group was 11.3% (s.d. 1.58%). Across treatments, a single dose of vaccine administered intranasally at processing was as effective as two doses administered IN/IN, IN/IM or IM/IM (p>0.05). These results indicate that the greatest mortality occurred during the pre-weaning phase rather than the nursery phase.

TABLE 4

Average total mortality during both the pre-weaning and nursery phases

| Group No. | Routes of Administration | Percent Mortality | Standard Deviation |
|---|---|---|---|
| 1 | IN/IN | 12.7 | 2.61 |
| 2 | IN/IM | 14.5 | 7.68 |
| 3 | IM/IM | 12.0 | 3.67 |
| 4 | IN (single dose) | 11.3 | 1.58 |

Table 5 shows the percentage of piglets treated with antibiotics. The IN/IN and IN/IM groups had an average treatment mortality rate of 8.78% (s.d. 3.84%) and 9.53% (s.d. 6.17%), respectively. The IM/IM group was 7.63% (s.d. 3.53%) while the average treatment rate observed in the IN (only at processing) group was 6.88% (s.d. 4.82%). Again, piglets receiving a single intranasal administration at 3-5 days of age or intranasal administration at 3-5 days of age followed by a second intranasal administration at weaning (about 21 days) required no more antibiotic treatments than piglets receiving regimens including intranasal administration followed by intramuscular or two intramuscular administration (p>0.05).

TABLE 5

Percentage of piglets treated with antibiotics during the study

| Group No. | Routes of Administration | Percent Mortality | Standard Deviation |
|---|---|---|---|
| 1 | IN/IN | 8.78 | 3.84 |
| 2 | IN/IM | 9.53 | 6.17 |
| 3 | IM/IM | 7.83 | 3.53 |
| 4 | IN (single dose) | 6.88 | 4.82 |

For nursery pigs grading as poor quality (see Table 6), the IN/IN and IN/IM groups had average poor quality of 22.60% (s.d. 4.91%) and 24.53% (s.d. 8.39%), respectively. "Poor quality" was defined as any pig that could be downgraded for any reason (for example, lighter weight). The IM/IM group was 22.65% (s.d. 6.02%) whereas the rate of poor quality pigs observed in the IN (only at processing) group was 22.23% (s.d. 11.63%). Across treatments, the type of administration did not significantly affect the percentage of poor quality pigs observed at the end of the nursery phase (p>0.05).

TABLE 6

Percentage of poor quality piglets in the nursery

| Group No. | Routes of Administration | Percent Mortality | Standard Deviation |
|---|---|---|---|
| 1 | IN/IN | 22.60 | 4.91 |
| 2 | IN/IM | 24.53 | 8.39 |
| 3 | IM/IM | 22.65 | 6.02 |
| 4 | IN (single dose) | 22.23 | 11.63 |

In summary, the nursery performance for the parameters measured, demonstrated that a single intranasal dose administered at 3-5 days of age or two intranasal doses administered at 3-5 days of age and again at about 21 days of age were as effective as regimens that included intramuscular administration. However, the intranasal administration has additional advantages over intramuscular administration, including not involving stressful needle injections to neonatal pigs, not involving injecting the neonates with live or modified live organisms that can shed and spread disease, not leaving any injection site lesions and thus allowing a zero day withdrawal time, and being easier to administer and thus reducing the workload and worker's risk of accidental self-injection for those administrating the composition. Furthermore, the intranasal administration may result in the neonate developing IgA antibodies that can overcome maternal IgG antibodies that are transferred from the sow or gilt.

Example 6—Swine Influenza Virus

Introduction

Swine influenza is an acute, highly contagious, respiratory disease resulting from type A swine influenza virus (SIV, also identified as IAV-S) infection. SIV is the leading cause of disease on swine farms in the US, affecting 61.5% of wean-to-finish farms, 59.4% of grower/finisher farms, 46.2% of nursery farms, and 25.5% of sow farms. It has been estimated total economic damage of $1.3 billion between May and October of 2009 caused by the SIV epidemic in the US. Financial losses attributable to SIV were estimated by one US swine producer at $10.31 per market pig. Vaccination is the main method of SIV prevention in pigs, with primary vaccination consisting of 2 injections 2 to 4 weeks apart, with biannual booster vaccinations recommended for sows. Unlike for other swine diseases, such as leptospirosis and *Erysipelothrix*, where vaccination levels on US breeding farms approach 90%, typically only 46.4% of breeding farms vaccinate female pigs for SIV.

Adjuvants are substances that, when mixed with an antigen, enhance its immunogenicity. Adjuvants are often used to boost the immune response when an antigen has low immunogenicity or when only small amounts of the antigen are available. For example, the antibody response of mice to immunization with bovine serum albumin (BSA) can be increased fivefold or more if the BSA is administered with an adjuvant. Adjuvants function by prolonging antigen persistence, enhancing costimulatory signals, causing higher local inflammation, stimulating the nonspecific proliferation of lymphocytes, or by performing a combination of the above. Good adjuvants can enable a reduction of the dose or the concentration of the antigen within a vaccine, decreasing the cost of the vaccine. All data indicate that the selection of the appropriate adjuvant as well as the mass of antigen, both of which differ between commercial vaccines, are at least as important for the potency of SIV vaccines as the selection of the SIV strains in the vaccines.

Emulsion-based adjuvant systems have been widely utilized in vaccine formulation. Several different classes of emulsions exist, such as oil-in-water (O:W) emulsions, water-in-oil (W:O) emulsions, water-in-oil-in-water (W:O:W) emulsions, and protein-stabilized emulsions. Water-in-oil-in-water emulsions contain water droplets within larger oil droplets, which are themselves suspended within a bulk aqueous solution. Whereas O:W emulsions are generally preferred for human applications, both W:O:W and W:O emulsions are widely used in veterinary vaccines. The advantages offered by W:O:W emulsions are their low viscosity as well as their ability to enhance the short and long term immune responses. Oil-adjuvanted vaccines significantly increase humoral immunity and generate higher antibody formation.

Typically, a hemagglutination inhibition (HI) titer of >1:40 is considered protective for SIV. However, it has been reported that vaccination with an inactivated SIV vaccine in pigs does not consistently generate complete immunity to virus challenges. The purpose of these experiments was to: 1) determine which MVP adjuvant would provide the optimal serological response when using inactivated SIV as the antigen; 2) evaluate whether a higher adjuvant concentration would produce greater antibody responses to SIV; 3); evaluate the effectiveness of a nanoparticle adjuvant delivered intramuscularly; and 4) determine which MVP adjuvant could produce antibody responses equivalent to or greater than an adjuvant included in one commercially available SIV vaccine for pigs.

Materials and Methods

Forty mixed sex commercial crossbreed swine of approximately 2 months of age were used and identified with identical numbered ear tags in each ear. Pigs were allowed to acclimate to the research facility for 3 days after placement at the research facility prior to initiating the trial. Five pigs were randomly allocated to each of 8 treatment groups (TGs), as per the rubric in Table 7. FluSure XP SIV vaccine (Zoetis, Inc.; Serial number: A283483A/A280666; Expiration date: Dec. 3, 2013; Lot number: 1285595) antigen was used as the antigen for this experiment. This antigen is an inactivated SIV that is lyophilized and provided separately from its commercial adjuvant.

TABLE 7

Experiment 1 Design

| TG Number[1] | Adjuvant | Lot Number | Number of Pigs |
|---|---|---|---|
| 1 | Negative control; PBS | 571 | 5 |
| 2 | Commercially available SIV vaccine adjuvant | 1285595 | 5 |
| 3 | Emulsigen ®-D 20% formulation | D1368 | 5 |
| 4 | Emulsigen ®-D 30% formulation | D1368 | 5 |
| 5 | Nanomune ™ 20% formulation | 062612 | 5 |
| 6 | Nanomune ™ 30% formulation | 062612 | 5 |
| 7 | Emulsigen ®-DL90 20% formulation | 062613 | 5 |
| 8 | Emulsigen ®-DL90 30% formulation | 062613 | 5 |

[1]TG = Treatment group; PBS = Phosphate buffered saline.

For all O:W emulsion adjuvants (Emulsigen®-D, Emulsigen®-DL90 and Nanomune), the lyophilized antigen was reconstituted to the labeled volume with sterile distilled water (DI) containing the concentration of adjuvant noted in Table 7. For the commercially available inactivated SIV vaccine, the adjuvanted diluent sold with the product was used to reconstitute the SIV antigen. Treatment Group 1 served as a negative control group, and received an identical injection of phosphate buffered saline instead of receiving SIV antigen or adjuvant. A 2 mL dose containing vaccine plus adjuvant was injected into each pig intramuscularly in the right side of the neck. The adjuvant that each TG received was as follows: TG 1: PBS as negative control (Lot number: 571); TG 2: adjuvant included in a commercially available SIV vaccine; TG 3: Emulsigen®-D formulated with antigen at a 20% concentration (MVP Adjuvants; Lot number: D1368); TG 4: Emulsigen®-D formulated with antigen at a 30% concentration (MVP Adjuvants; Lot number: D1368); TG 5: Nanomune, a nanoparticle adjuvant, formulated with antigen at a 20% concentration (MVP Adjuvants; Lot number: 062612); TG 6: Nanomune formulated with antigen at a 30% concentration (MVP Adjuvants; Lot number: 062612); TG 7: Emulsigen®-DL90 formulated with antigen at a 20% concentration (MVP Adjuvants; Lot number: 062613); TG 8: Emulsigen®-DL90 formulated with antigen at a 30% concentration (MVP Adjuvants; Lot number: 062613).

All pigs received 2 doses of vaccine and adjuvant based on their respective TGs; 1 dose on study day (D) 0, and 1 dose on D 21. Five to 10 mL of venous blood was drawn from each pig at 3 time points; on D 0, prior to immunization; on D 21, prior to immunization, and on D 42. Blood samples from each time point were split into 2 equal aliquots. One aliquot from each blood sampling day was used to test immunity using the HI assay by the Iowa State University (ISU) Veterinary Diagnostic Laboratory (VDL). Statistical analysis of serum antibody levels in this experiment was performed using repeated measures analysis of variance.

Results and Discussion

The results from this experiment are presented graphically in FIGS. 3 and 4. On Day 0, prior to vaccination, several HI antibody titers were positive, probably due to maternal antibody. Maternal SIV antibody levels are dependent on antibody levels in the sow and decline in piglets over a period of 4-14 weeks. It is noted that the TG1 titers declined from Day 0 to Day 42 so there was no SIV exposure during the study.

On D 21, using 1:40 as a cut-off point for successful generation of protective immunity to SIV, several pigs in the Emulsigen®-DL90 and the Emulsigen®-D treatment groups (TG 3, 4, 7, and 8) already possessed protective HI antibody levels against SIV. On Day 21, for the H1N1 strain of SIV, 20% of pigs in TG 3, 80% of pigs in TG 4, 80% of pigs in TG 7, and 60% of pigs in TG 8 possessed protective HI antibody levels whereas 0% of the pigs in TG groups 1, 2, 5 and 6 demonstrated such titers. On Day 21, for the H3N2 strain of SIV, 20% of pigs in TG 3, 80% of pigs in TG 4, 20% of pigs in TG 7, and 60% of pigs in TG 8 possessed protective HI antibody levels whereas 0% of the pigs in TG groups 1, 2, 5 and 6 demonstrated protective HI antibody titers whereas. Earlier generation of protective immunity ensures that pigs will be protected in the event they face a disease challenge prior to receiving both doses of vaccine. Additionally, these results indicate that even in the presence of maternal antibody, Emulsigen®-D and Emulsigen®-DL90 could produce protective titers at 21 days post a single vaccination.

Statistics

On Day 42, all pigs in all immunized treatment groups, TG 2-8, had protective levels of antibody for both the H1N1 and the H3N2 strains of SIV. Emulsigen®-DL90 produced higher antibody titers than any other adjuvant tested in this experiment, indicating the generation of the highest level of protective immunity of all adjuvants tested in this experiment. Emulsigen®-D also produced very high antibody titers, more than four-fold higher than the antibody titers produced by the adjuvant from a commercially available SIV vaccine (TG 2). Generation of higher antibody titer levels enables using lower levels of antigen, helping to reduce vaccine costs.

In this experiment, 3 of the analyzed adjuvants were tested at 2 different formulation concentrations, 20% and 30%. For all 3 of these adjuvants, the lower 20% concentration yielded higher antibody levels than did the 30% concentration. Adsorption of adjuvant to antigen is determined in part by the adjuvant:antigen ratio. Without being bound to a particular theory, an intermediate density of ligands, such as adjuvants, may provide statistically significant improvements in cell binding in comparison with both higher and lower densities of adjuvants. Higher adjuvant densities may bind and mask too many antigen receptors, lowering the number of antigen receptors available to bind host cells involved in the immune response and production of antibody, explaining the lower antibody titers noted when using a higher concentration of adjuvant.

Nanomune, a nanoparticle adjuvant, produced very low antibody titers. Adjuvants adsorb antigens and serve as a depot at the site of vaccine injection, slowly releasing antigen into the body, thereby allowing antigen-specific lymphocytes to be exposed to antigen for a longer period of time. Nanoparticles, due to their small size, may diffuse from the site of injection more quickly, resulting in less exposure to antigen-specific lymphocytes, and hence generation of lower levels of antibody. Further, adjuvant-antigen complexes involving nanoparticles are smaller than adjuvant-antigen complexes involving larger-sized adjuvants, lowering the likelihood of phagocytosis, in turn lowering the overall immune response and lowering antibody level.

Example 7

This experiment was performed identically to the experiment described in Example 6, except that it utilized different TGs receiving different adjuvants. Pigs were allocated to each of 8 TGs, as per the rubric in Table 8. Five pigs were allocated to TG 1-5 and TG 8. Ten pigs were allocated to each of groups TG 6 and TG 7. Serum was collected from all pigs on D 0, D 21 and D42.

TABLE 8

Experiment 2 Design

| TG Number[1] | Adjuvant | Lot Number | Administration[2] | Number of Pigs |
|---|---|---|---|---|
| 1 | Negative control; PBS | 598 | IM on D 0, D 21 | 5 |
| 2 | Commercially available SIV vaccine adjuvant | 1312332 | IM on D 0, D 21 | 5 |
| 3 | Emulsigen ®-D 20% | D1384 | IM on D 0, D 21 | 5 |
| 4 | Emulsigen ®-DL90 20% | 062014B | IM on D 0, D 21 | 5 |
| 5 | Emulsigen ®-BCL 20% | 17007 | IM on D 0, D 21 | 5 |
| 6 | Seppic W:O:W 50% | 082814S | IM on D 0, D 21 | 10* |
| 7 | MVP W:O:W 20% | 082814M | IM on D 0, D 21 | 10* |
| 8 | Carbigen ™ 10% | 18053 | Intranasally D 0, D 21 | 5 |

[1]TG = Treatment group; PBS = Phosphate buffered saline; DDA = dimethyldioctadecylammonium bromide; W:O:W = Water-in-oil-in-water immersion; IM = intramuscular; D = Study day.
[2]All IM injections administered in the right side of the neck; IM injections administered as a 2 mL dose; Intranasal administration was 1 mL in each nostril, for a total dose of 2 mL.
*10 pigs total were included in TG 6 and TG 7.

FluSure XP SIV vaccine (Zoetis, Inc.; Serial number: A309195/A310732; Expiration date: Mar. 3, 2015; Lot number: 1312332) an inactivated, lyophilized antigen was used as the antigen for this experiment. This antigen was mixed as follows with a different adjuvant for each TG. For all O:W emulsion adjuvants (Emulsigen®-D, Emulsigen®-DL90 and Emulsigen®-BCL), the lyophilized antigen was reconstituted to the labeled volume with sterile distilled water (DI) containing the concentration of adjuvant noted in Table 8. For the commercially available SIV vaccine, the adjuvanted diluent sold with the antigen was used to reconstitute the SIV antigen. For the Seppic W:O; W emulsion (ISA 201) adjuvant, SIV antigen was reconstituted with 50% of the required diluent as PBS and the ISA 201 was added at a 50% concentration according to directions provided by the manufacturer. For the MVP W:O:W emulsion adjuvant, SIV antigen was reconstituted with 80% of the required diluent after which the MVP W:O:W emulsion was added at a 20% concentration. For the Carbigen™ adjuvant, the adjuvant was first added to the required volume of PBS, the pH was adjusted to between 6.0 and 6.5 using 10N NaOH and then this was used to reconstitute the lyophilized SIV antigen to the concentration listed in Table 8.

Treatment Group 1 served as a negative control group, and received an identical injection of PBS instead of receiving SIV antigen or adjuvant. The adjuvant that each TG received was as follows: TG 1: PBS as negative control (Lot number: 598); TG 2: adjuvant included in a commercially available SIV vaccine; TG 3: Emulsigen®-D formulated at 20% with DDA (MVP Adjuvants; Lot number: D1384); TG 4: Emulsigen®-DL 90 formulated at 20% with DDA (MVP Adjuvants; Lot number: 062014B); TG 5: Emulsigen®-BCL formulated at 20% (MVP Adjuvants; Lot number: 17007); TG 6: Seppic W:O:W formulated at 50% (MVP Adjuvants; Lot number: 082814S); TG 7: MVP W:O:W formulated at 20% (MVP Adjuvants; Lot number: 082814M); TG 8: Carbigen™ formulated at 10% (MVP Adjuvants; Lot number: 18053).

A 2 mL dose containing vaccine plus adjuvant was injected into each pig intramuscularly in the right side of the neck for TGs 1-7. Treatment group 8 received a 2 mL dose containing vaccine plus adjuvant administered intranasally, with 1 mL administered into each nostril. All pigs received 2 doses of vaccine and adjuvant; 1 dose on D 0, and 1 dose on D 21. Blood sampling and analysis was the same as described for experiment 1 above. Statistical analysis of serum antibody levels in this experiment was performed using repeated measures analysis of variance.

All serum samples were split into two aliquotes. One aliquot was sent to Iowa State University diagnostic laboratory for testing of hemagglutination inhibition titers. Samples were blinded as per group and sampling day. Geometric mean data were analyzed statistically using repeated measures analysis of variance.

Results and Discussion

Figure 5:
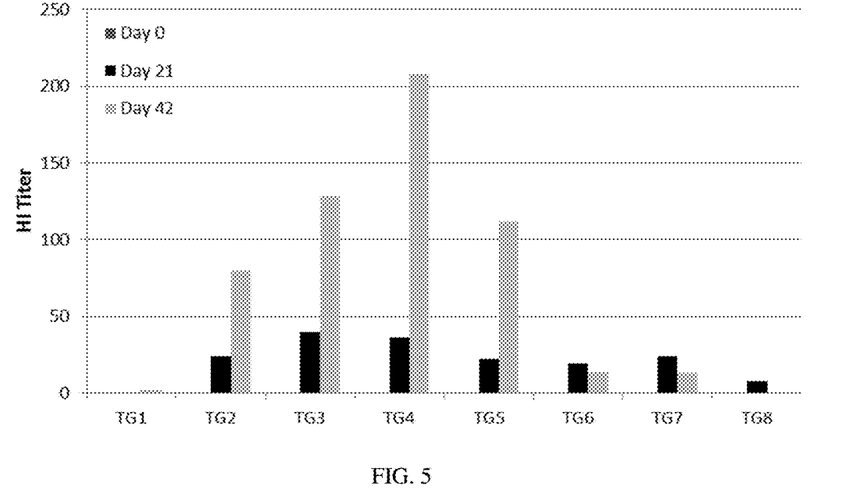
FIG. 5 is a graph of Hemagglutination inhibition (HI) titer versus treatment group (TG), illustrating the HI titers by treatment group for H1N1 swine influenza virus in Example 7.
Figure 6:
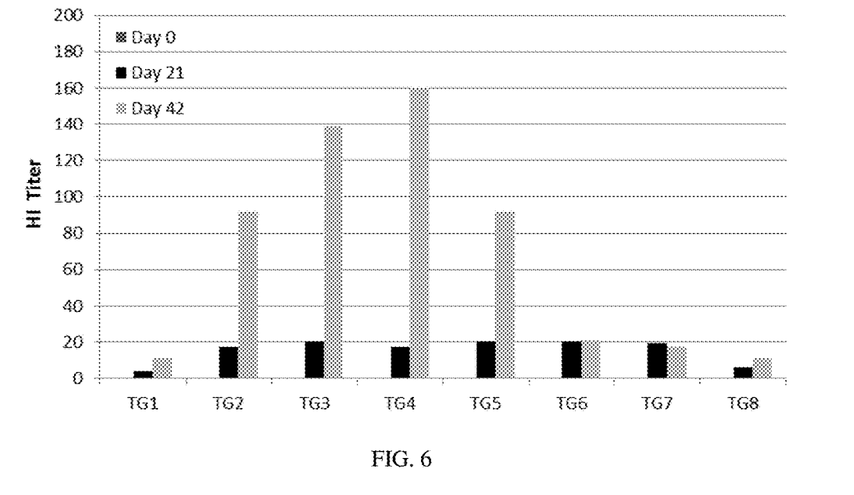
FIG. 6 is a graph of HI titer versus treatment group, illustrating the HI titers by treatment group for H3N2 swine influenza virus in Example 7.
Figure 7:
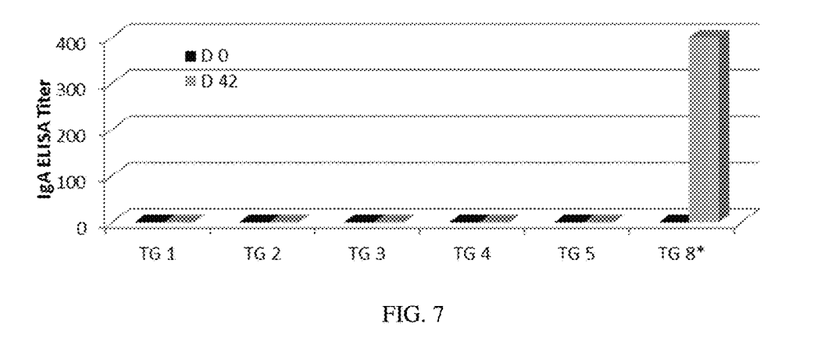
FIG. 7 is a graph of IgA ELISA titers versus treatment group, illustrating the IgA titers for the various treatment groups in Example 7.

The results from this experiment are presented graphically in FIGS. 5-7, and in Tables 9 and 10.

TABLE 9

Hemagglutination Inhibition IgG Titers

| | Day 0 | | Day 21 | | Day 42 | |
|---|---|---|---|---|---|---|
| Adjuvant | H1N1 | H3N2 | H1N1 | H3N2 | H1N1 | H3N2 |
| No Adj | 0 | 0 | 0 | 0 | 2.5 | 12.5 |
| Amphigen | 0 | 0 | 24 | 24 | 80 | 96 |
| EM-D 20% | 0 | 0 | 40 | 40 | 128 | 144 |
| EM-DL90 20% | 0 | 0 | 36 | 36 | 208 | 192 |
| EM-BCL 20% | 0 | 0 | 22 | 22 | 112 | 96 |
| SEPPIC WOW 20% | 0 | 0 | 19 | 19 | 14 | 22 |
| MVP WOW 20% | 0 | 0 | 24 | 24 | 13 | 18 |
| Carbigen 10% | 0 | 0 | 8 | 0 | 0 | 12 |

TABLE 10

SIV Specific IgA response as measured by ELISA

| IgA | Day 0 | Day 42 |
|---|---|---|
| Control | 0 | 0 |
| Amphigen | 0 | 0 |
| EMULSIGEN-D | 0 | 0 |
| EMULSIGEN-DL90 | 0 | 0 |
| EMULSIGEN-BCL | 0 | 0 |
| CARBIGEN-IN | 0 | 400 |

In this experiment, no positive antibody titers were found on Day 0, prior to immunization, indicating the lack of any maternal antibody, enabling definitive determination that all detected antibody resulted from immunization and not from any minor lingering levels of maternal antibody. On Day 21, for the H1N1 strain of SIV, 20% of pigs in TG 2, 60% of pigs in TG 3, 80% of pigs in TG 4, 20% of pigs in TG 5, 10% of pigs in TG 6, 20% of pigs in TG 7 and 0% of pigs in TG 8 possessed protective HI antibody levels. On Day 21, for the H3N2 strain of SIV, 20% of pigs in TG 3 possessed protective HI antibody levels. More importantly, in this experiment, Emulsigen®-DL90 once again produced the highest antibody levels followed by Emulsigen®-D, indicating the generation of the highest level of protective immunity of all adjuvants tested in this experiment. Generation of higher antibody titer levels enables using lower levels of antigen, helping to reduce vaccine costs.

It was expected that the water-in-oil-in-water adjuvants (WOW) would produce much higher antibody responses as this category of adjuvant is considered to be most effective with numerous antigens. Both WOW adjuvants produced extreme injection site reactivity as visually observed by the attending veterinarian (data not shown) which would normally suggest stimulation of a very high immune response.

The Carbigen™ adjuvant administered intranasally did not produce an IgG HI or ELISA response (data not shown). However, when IgA responses were measured using an ELISA specific for SIV IgA detection, this group (TG 8) was the only group that produced a response which remained high at 42 days (FIG. 7). Carbigen™ is an adjuvant that is known to have mucoadhesive properties. Therefore, it is more appropriate for use with intranasally administered antigens. In this case, an inactivated antigen, when administered intranasally with Carbigen™ adjuvant stimulated a high IgA response as measured in the serum of the pigs.

Conclusion

In both Example 6 and Example 7, Emulsigen®-DL90 produced the highest HI (IgG) antibody levels, indicating the generation of the highest level of protective immunity of all adjuvants tested in these experiments. Emulsigen®-D also produced very high antibody titers. These titers were two to four fold higher than the antibody titers produced by the adjuvant from a commercially available SIV vaccine adjuvant. Both these adjuvants produced higher titers than either a nanoparticle adjuvant or two WOW adjuvants evaluated in these Experiments. Additionally, it was shown that a mucoadhesive adjuvant (Carbigen™) produced a very high IgA response in serum when used to adjuvant the inactivated SIV antigen.

Example 8—SIV (IAV-S) Early Proteins as Inactivated Vaccines Administered Intranasally In this example, antigens are prepared by extracting early proteins from SIV (IAV-S) produced in tissue culture. Such proteins are called early proteins because they are produced within the first 2-10 hours of tissue culture infection by subtypes of SIV (IAV-S). Such subtypes are typically H1N1 and H3N2 but can by any other of the subtypes of this virus. Early proteins are produced by infecting tissue culture cells grown in flasks, roller bottles or bioreactors with an SIV (IAV-S) virus subtype. Optionally, Trypsin can be used to enhance the infection with the viruses. The infected cells are then incubated for between 2 and 10 hours at 35-37° C. after which the supernatant is removed and the early proteins in the cells are released. The release of the early proteins is accomplished by freezing and then thawing the cells sheet in the presence of a buffer or by addition of a buffer such as one containing TRIS, EDTA and TRITON-X-100, NP40 or other equivalent surfactant.

The early proteins are then inactivated using any of the typical inactivating agents such as binary ethyleneimine, formalin, formaldehyde or betapropiolactone. If a TRIS, EDTA, surfactant extraction process is used, an additional inactivating agent may not be necessary as the virus is already inactivated.

These early proteins of SIV (IAV-S) are then formulated into a vaccine by adding mucoadhesive adjuvant(s). One of these adjuvants can be Carbigen™ It is expected that this inactivated SIV (IAV-S) vaccine can be administered intranasally to pigs to produce an IgA response that would be able to overcome the maternal antibody in such pigs. It is also expected that such proteins may be cross-protective, unlike the hemagglutin and neuraminidase proteins of SIV (IAV-S).

IV. Statements

Disclosed here are embodiments of a composition formulated for mucosal administration to an animal, the composition comprising inactivated bacterial antigens and at least one mucoadhesive adjuvant. The mucoadhesive adjuvant may be selected for intranasal administration, and/or may comprise a polymer, an oil-in-water emulsion, a saponin, a nanoparticle, a surfactant, a lipid, or a combination thereof. In some embodiments, the mucoadhesive adjuvant comprises a carbomer or nanoparticle, and may comprise polyacrylic acid.

In any of the above embodiments, the inactivated bacterial and/or viral antigens may be selected from antigens from *Streptococcus suis, Haemophilus parasuis, Actinobacillus suis* or a combination thereof, from swine influenza virus (SIV or IAV-S), porcine reproductive and respiratory syndrome virus (PRRSv), porcine epidemic diarrhea virus (PEDV), rotavirus, or a combination thereof, or any other types of bacteria or viruses wherein disease is introduced via a mucosal membrane. In certain embodiments, the inactivated bacterial antigens comprise antigens from at least one strain or serovar of *Streptococcus suis* and at least one strain or serovar of *Haemophilus parasuis*; antigens from at least one strain or serovar of *Haemophilus parasuis* and at least one strain or serovar of *Actinobacillus suis*; and/or antigens from at least one strain or serovar of *Streptococcus suis* and at least one strain or serovar of *Actinobacillus suis*. In particular embodiments, the inactivated bacterial antigens comprise antigens from at least one strain or serovar of *Streptococcus suis*, at least one strain or serovar of *Haemophilus parasuis* and at least one strain or serovar of *Actinobacillus suis*.

In some embodiments, the inactivated antigens are selected from whole culture bacteria, subunits that have been extracted or separated from the culture, extracts, antigens obtained from recombinant organisms other than S. suis, A. suis or H. parasuis but which protect against S. suis, A. suis or H. parasuis infection or challenge, inactivated vector-delivered antigens, inactivated recombinant organisms carrying S. suis, A. suis, H. parasuis antigens, or a combination thereof.

The composition may further comprise one or more additional antigens selected from antigens of M. hyorhinis, M. hyosynoviae, P. multocida, B. bronchiseptica, E. rhusiopathiae, S. cholerasuis, S. typhimurium, C. perfringens, C. difficile, E. coli, porcine rotaviruses, swine influenza virus, porcine reproductive and respiratory syndrome virus, porcine epidemic diarrhea virus, or porcine parvo virus.

The composition may further comprise an inactivating agent. In some embodiments, the inactivating agent is formaldehyde, formalin, binary ethyleneimine, thimerosal, beta propiolactone, or a combination thereof.

The composition may further comprise a diluent, preservative, antimicrobial agent, or a combination thereof.

In some embodiments, the inactivated antigens are present in an amount of from about $10^2$ to about $10^{10}$ CFU/mL.

The animal may be a pig. In some embodiments, the animal is a neonatal or nursery pig.

In some embodiments, the composition is a vaccine.

In particular embodiments, the composition comprises inactivated antigens of *Streptococcus suis, Haemophilus parasuis, Actinobacillus suis* or a combination thereof, and a mucoadhesive adjuvant comprising polyacrylic acid, and wherein the composition is formulated for intranasal administration.

Also disclosed herein is a method, comprising administering mucosally to an animal an effective amount of a first composition according to any one of the embodiments disclosed herein. The animal may be a pig, and in some embodiments, the pig is a neonatal pig or a nursery pig. The pig may be 10 days old or less, 5 days old or less, or 3 days old or less.

In some embodiments, administering mucosally comprises administrating intranasally.

Administering mucosally an effective amount of the first composition may comprise administering mucosally an amount of the first composition sufficient to produce an IgA immune response in the pig, compared to a pig that is not mucosally administered the first composition.

In some embodiments, the method further comprises administering a second composition comprising inactivated antigens of *Streptococcus suis, Haemophilus parasuis, Actinobacillus suis* or a combination thereof. The second composition may be administered intranasally or intramuscularly. In some embodiments, administering the second composition comprises administering the second composition within two to six weeks of the administration of the first composition.

Also disclosed herein are a method of vaccinating swine against diseases of *Streptococcus suis, Haemophilus parasuis, Actinobacillus suis* or a combination thereof, the method comprising administering inactivated one or more antigens from *Streptococcus suis, Haemophilus parasuis, Actinobacillus suis* or a combination thereof, to a pig by an intranasal route. And a method for reducing the incidence or lessening the severity of at least one clinical sign associated with *S. suis, A. suis* or *H. parasuis*, the method comprising administering mucosally to a pig the composition according to any one of the above statements.

In view of the many possible embodiments to which the principles of the disclosed invention may be applied, it should be recognized that the illustrated embodiments are only preferred examples of the invention and should not be taken as limiting the scope of the invention. Rather, the scope of the invention is defined by the following claims. We therefore claim as our invention all that comes within the scope and spirit of these claims.

SEQUENCE LISTING (30 sequences)

SEQ ID NO: 1 - DNA, 2007491 bp, Streptococcus suis
atgaaccaagaacaacttttttggcaacgatttattgaattggcaaaggtaaattttaagccatctatttatgatttttatgtcgctgatgcaaaattactcggaatcaaccagcaagttgccaatattttcttaaatcgtccatttaaaaaagatttctgggaaaaaaacttcgaagagttaatgattgccgctagttttgaaagctacggagagcctcttaccatccaatatcaatttacagaggatgaacaggagattaggaatactacaaacacaagaagttcaatagttcaccaggtacagacacttgagccggctactcctcaagaaacttttaaaccggttcattctgatataaaatcccagtacacctttgctaattttgtacaaggagacaataatcactgggcaaaggctgcagctttagctgtatctgataacctaggtgagctctacaatccattattcatttttggtggtcctggtcttggaaaaactcatattttaaatgcgattggaaataaggttctagccgataatccccaggcaaggataaaatatgtctcatcggaaacattcatcaatgaatttttagaacacctccgtctcaatgatatggaaagtttcaaaaaaacctatcgcaatctggacttacttctaattgatgacattcagtctctccgtaataaagcaacaacacaggaagaatttttccatacttttaatgcgcttcatgaaaaaaataagcagattgtactcacaagcgaccgtaatcccgatcacttagacaatttggaagaaagactagtaacacgtttcaaatgggggttaaccagtgaaatcactccacctgattttgaaacacgtatcgcaattttacgtaacaagtgcgagaacctgccttacaactttacaaatgagacgctatcctatctagctgggcaatttgattcgaacgtacgtgaccttgaaggtgccttaaaagatatccatttgatagccactatgcgtcaactgtctgagataagtgtcgaggttgctgctgaggctattcgatcaagaaaacaaacaaatccacaaaacatggttattcctattgagaaaatccaaaccgaagtgggaaatttctacggtgtcagcttgaaagaattaaaaggttctaagcgtgttcaacatatcgttcacgcgcgacaagttgctatgtttttagcacgtgaaatgacagacaattcccttccaaaaattgggaaagaatttggtaatcgagaccatacaaccgttatgcatgcatacaataaaataaaaactctcctcttggatgatgagaatttagaaatagagattaccagtataaaaaataaacttcgttaacctgtgtataacttttttaaaaaactctgttttttccacaagttgtgaacaagttaatttccgcagttttattggtctttcatcacttttccacagaatacacagagactactattactattaaccttatagataataaataaaggagaatccatgattcaattttctattaataaaaatatatttctacaagcacttagtattactaaacgggcaatcagtacaaaaaatgctattccaattctttcaacagtaaaaattacagtaactagtgaaggaatcactttaactggttcaaatggacaaatctcgatagaacattttatttctattcaagatgaaaatgcagggcttttgatcagttctccaggttccattctcttagaagctggtttctttattaatgtcgtatccagtatgccggatttggtccttgacttcaatgaaattgaacaaaagcaaatcgttttgacaagtggtaagtctgaaatcacattaaagggaaaagaagcagaacagtatcctcgtttacaggaagttccaacttcaaaaccattggtgttagaaaccaaagtattaaaacaaacaattaatgaaacagcatttgcagcttctacacaagaaagtcgtcctattcttacgggtgttcattttgttttaacagaaaataaaaatctaaaaactgttgcaacagattcacaccgtatgagccaacggaaattggtccttgatacctctggtgatgattttaatgttgtcattccaagtcgttctctccgtgaatttactgcagtttttacagatgatattgaaacagtagaagtcttcttttcaaataatcaaatcctttttagaagcgagcatattagcttctatacacgcttattagaaggtacctaccctgataccgaccgcttaattccaactgagtttaaaacaactgcaatttttgatactgcaaatcttcgtcactcgatggagcgtgctcgtcttctttcaaatgcaacccaaaatggtacagtaaaactagaaattgctaataatgttgtatcggctcatgtaaattctccagaagttggacgtgtgaatgaggaattagatactgtagaagtatcaggtgaagatttagtaatcagctttaacccaacttacttgatagaagcattgaaagccacaactagtgaacaagtgaaaattagctttatctcttctgtccgtccatttacattgattccaaataatgaaggggaagattttattcaattggttacaccagttcgtaccaactaaataatattaagaacggctaaactagccgtttttatgttatactaaaaaatagcacctagcttatttttatatatttagtgatggggaataaatgacgttatatatattagctaatcctaatgctggtagccatactgctgaacatatcatattcaaaataaaagaaagttatccacagcttgcagttaacatttttatgacagttggtcctgaggatgaaaaaagtcaaatagaggctattttaaaggagtttgtcagtagtgaagatcaattaatgattttaggcggagacggcacactatctaaagctttgcgtttttggccagctagtctaccgtttgcttattatccaacaggatctggaaatgattttgctaaggcaatgaatataacatcgctatatagaagtgtagatgccattttagagagaaaaacaagtcggatatatgttttaaacagttcatacggaacggttgtaaacagtatggattttggctttgcagctcaagttatcaatggttcaacgaattcaattttgaaaaaaattctgaacaaggtaaaacttgggaagttaacttatctattctttggtattaaaacattattttcaaaacaagctataaacttagaattaactcttgatgaaaaatcttatcagttagataatctcttttttatttctgtagcaaatagtctttattttggtggaggaatcatgatatggccaacagcaagtgctaaaaagaaggaagtagatattgtttacttcaaaaatggaaatttctaccaacgtctacaatcattgttagccttattaacgaagaggcatgaatcttctcatacgattcagcatttaacaggggtagatgtagttttaaaatcaaaagaaaaattattattgcaaatagatggagagacatgcactgcaaatgaggtaacgttaacctatcaggaaagaagtatgtatctttaaggaggaagtatgtaccaattaggaacctttgtcgaaatgaaaaagccccatgcctgtgtcatcaaatcgaccggaaagaaggctaataaatgggaggttatccgtctaggagcggatattaaaatccgctgtaccaactgtgaccatgtcgttatgatgagccggcatgattttgaacgaaaaatgaaacaagttctgccaagtgaagcctagttgacagtttgcaactactggttgcgaatttttcctaaaaagtgctagtcaactgttcctttctaaactataatagacttagaaaaaagaggaggaaatgatcatgaagcagttagcacagcaaattcgagttttacgcacagccaagaacctatcccaagatgagttggcagagaaactctatatttcccgtcaggctgtttccaagtgggaaaatggtgaagccacaccagatattgacaaactggtccagctggcagaaatctttggtgtcagtctggattatctggttttagggaaagaacctgagaaggaaattgtggtggaacaacgaggaaaaatgaatggttgggaattcttgaacgaagaatccaaacgacctcttacaagaggagatgttgtccttctcatttttcttgcagttatgcttttaggtggattatttattaagcattatttttaacgaagcttgccaaacagcaagctttttctctacttttctgctataatagtcatgattgaatttttaattggagagtaaaaaaaacatgtctttaacagcaggaatcgtcggtttgccaaacgttggtaaatcaaccctatttaacgcaattaccaaggcaggagcagaagctgcaaactaccctttcgcaactattgatccaaacgtcggcatggtagaagtgcccgatgagcgtctgcagaagttgaccgaactcatcatccctaaaaagacagtgccaacgacttttgaatttactgatattgctggtatcgtaaaaggtgcttctaaaggtgaaggacttggaaataaattcttggccaatatccgcgaagttgatgcgattgtccacgttgtgcgtgcctttgacgatgaaaatgtcatgcgtgaacaaggccgtgaagatgcctttgtggatccaatcgctgatattgataccattaacctagaattgattttggcggacctagagagcatcaacaagcgttatgcgcgtgtagaaaaaatggcccgtacgcaaaaagacaaagattctgtcgcagaatttgcagttcttgaaaaaatcaaacctgtcctagaagacggaaaatctgcccgcacagttgagttcacagatgaagaacaaaaaatcgttaagcaactcttcctcttgaccactaaacccgtcctctatgttgccaatgttgatgaagacaaggtagcagatcctgaggctatcagttatgttcagcaaatccgtgactttgcagcaacagaaaatgcagaagtggtggtgatctctgcgcgtgctgaagaagaaatttcagaactcgacgatgaagacaagggcgagtttttagaagcactcggattaacagaatctggcgtggacaaattaacacgtgcagcctatcacttgcttggtctaggcacctactttacagcaggggagaaggaggttcgtgcttggaccttcaaacgtggtatgaaagctcctcagtgtgcaggcattatccattcagacttcgaaaaaggttttatccgtgccgttaccatgtcatacgatgatttaatgacctacggctctgagaaggctgttaaagaagcaggacgccttcgtgaagaaggaaaagagtacgtggttcaagatggggacatcatggagttccgctttaacgtttgattgctaaactgtccttattcttcgttgttttaccttgccataccatcagtattgtctgcggtttcaacgcctagactaagaacagtttatcgcatcaaagaggatgattacttggttggaaagctttttccagccttttggtatttaaggagaaaaaatgacacgattgattatcggtttgggaaatcccggagaccgctattttgaaacaaaacataacgttggttttatgctgctggataagattgctaagcgtgaaaatgtgacctttaaccacgataagattttccaagcagacattgccacaacctttattgatggtgaaaaaatttacctggtcaaaccaacgactttcatgaatgaatcaggtaaggctgtccatgccttaatgacttattatggtctggatgcaactgatattttagtagcttatgacgacttggacatggctgttggaaaaatccgtttccgtcaaaaaggctcagctggtggccacaatggtatcaaatccattgtcaagcatattggaacacaggaatttgaccgtatcaagattggtattgggcgtcctaaaggaaaaatgagcgttgtaaaccatgtcttgtctggctttgatatagaggaccgtattgaaatcgacttagcactagataaacttgacaaggctgtcaacgtatatctcgaagaagatgattttgatacagtaatgagaaagtttaacggataatgaatatactcgatttacttcacaagaacaagcaaatcaatcaatggcagtcaggattgaatcaatcaacacgtcagttattattaggactatctgggactagtaagtcacttataatggcgactgcctatgattgtttggccgaaaagattatgattgtgactgccactcaaaatgatgctgagaaattagttgcagatttaacagccattattggaagtgagaatgtttacaacttttttacagatgatagtcctattgccgagtttgtttttgcatcaaaagaacggactcaatcaaggattgacagtttaaatttcttgacagattctaccagttcaggaattttagttgctagtatagttgcttgtcgggtcttattgccgagtcctgagacttataaaggttctaaaatacagcttgaagttggtcaagaaatagaagttgacaaacttgtaaagaaccttgtcaacatcggctacaaaaaagtgtctcgtgtattaacccagggagaatttagccaacgaggtgatattctagatatttttgacatgcaatcagaaacaccttaccgaatagaattttttggagatgagattgatggcattcgtatctttgatgttgacagtcaaaaatccttagaaaatctagacgaaatctcgatctctccagcttccgatatcattttgtcttcagaagactatagtagagctagccaatacattcagacagctattgaacaatcgactctagaggagcaacagtcttacttacgagaagtcttagctgatatgcagacggagtaccggcatccagatttgcgtaaattcttgtcctgtatctatgaacaatcatggacattgttggattacttgccaaagagttctcccttatttttggatgattttcataaaatcgctgataagcaggctcaatttgaaaaagaaattgcagacttgttgacagatgatttacagaagggtaaaacagtgtcaagtttgaaatattttgcctcaacttatgctgaattgagaaaatacaaacctgccaccttcttttcaagttttcaaaaaggtttaggaaatgtaaagtttgatgctctttatcaattcacacagcatcctatgcaggaatttttccaccagattccactgttaaaagatgaattgactcggtatgcgaaatcaaacaataccgttgttattcaagcgagttctgatgtaagtttacagactttacagaaaaatttacaagagtatgatatccatcttccagtacatgcagcagataagttagtagaaggtcagcaacaggttacgattggtcagttagcttcaggttttcatttgatggatgagaaactagttttcatcactgaaaaagagattttcaataagaaaatgaagcgtaagacacgtagaaccaatatttctaacgctgaacgtattaaggactatagtgaattagcagttggtgactatgttgttcaccatgttcatggtatcggtcaatacttaggaattgagactattgaaatttcaggcattcatcgtgattatttaacggttcaatatcaaaactccgatcgcatttctattcctgtagaacaaattgatcttctctccaaatacttagcgtccgatgggaaagctccaaaagttaataaactaaacgatggccggttccaacgaaccaagcaaaaagttcagaagcaagtggaggatattgcagatgatttgattaagctttatgcggagcgtagtcagctgaaaggctttgccttttcacctgatgatgaaaatcaagttgaatttgacaactactttacacacgtggaaaccgatgaccaactccgttccattgatgaaatcaaaaaagacatggaaaaagactctccaatggaccgtctgttagtaggagatgtcggatttggtaagacagaggtagccatgcgcgctgctttcaaagcagtcaatgatggcaagcaagtagctattcttgtacctacgactgttttagcccagcaacactatgctaatttccaagaacggtttgcagaatttcccgtcaatgtggatgttatgagtcgttttaaaacaaaggcagagcaggaaaaaacacttgagaagttgaaaaaaggccaagttgacatcttgattggtacccatcgccttctatcaaaagatgttgtttttgctgatttaggtttactggttattgacgaagagcaacggtttggtgtcaagcataaggaacgcttgaaggaactgaaaaagaaaatagatgtcctaaccttgactgcaactccgattcctcggacattgcaaatgtccatgctgggaatccgcgacttatcagtaattgagactccaccgacaaatcgctatcctgtacaaacttatgtgatggaaacaaatccttccgttatccgagatgcaatgcttcgagagatagatcgcggaggtcaggtttactatctttacaataaagttgataccattgaacagaaagtgtctgaattaaaagaattggttccagaagctactataggatacgtccatggacaaatgtcggagatccaattagaaaatactctctatgcttttgtagagggtgaatatgatattctagtgaccacaacaatcatcgaaacaggtgttgatattccaaatgctaatacactgtttattgaaaatgcagatcatatgggactgtcaactctttatcaacttagaggacgtgttggccgttccagtcggattgcctatgcctatctcatgtaccgtccagacaagtccttgacagaagtagctgaaaaacgtttggaggcaatcaagggctttacagaactaggatcaggtttcaagattgccatgcaagatttgtccattcgtggtgcgggaaatattttaggtgctgctcagtcaggttttattgattctgtgggatatgagatgtattcacaattgctggaacaagctatcttggaaaaacaaggtaaggcaacccaacgtcagaagagtaattccgaggtcaatttacagattgatgcctatttaccaagtgattatattggtgatcagcgacaaaaaattgaaatttacaagcgtataaagaatattgacagtcgtgtcaactatcaagaattgcaagaagaattgattgaccgttttggagagtatcctgatgtagtagcctacttgcttgaaatcggtctactgaagtcatttttagaccaagttttctgtcatacagttcttagacgacaacatcaagtgacagtaacattcgaacctatggctggtcaaattttcctaacgcaagattactttgaagctttatctgtgacaaatttgaaagctcagataacggaaaataaaggaaaactagctgttgtgtttaacattcaacagaaaaaagaatatgaaatattagaggaattgatttcttttgccgaaaaattaaaagaaattaaagcaaggaaggcagaataaatttctcaaataccttgaaaaatggtaaaataatgaactgaggtaaagtatgagactagataaatatttgaaagtatcccgcattatcaagcgtcgaacagttgcgaaggaagttgccgataaaggacgaataaaagtcaatgggattttggcgaaatcttcaacagatttaaaagtaaatgatcaggttgaaatccaatttggtaataaactactcactgtaaaagtacttgaaatgaaagattcgactaaaaaagaagacgcactgaaaatgtatgaaattatcagtgaaaaaaggatagaaaaagatgaagaaatctaaaattctacaactgaataatgcctttattcagtcggagcgtaaaaaaactcagcatcaattggcagaacgccaacaaaaaaatcgttttatgggtgcaattctcattctagttatctttctttttatgttgcctgcctataatcttgttgggacttacactaatattcagcagcaggaaaagaaacttgctgaattggaaaaaaattacgaagaactgaccaaagaacagaagcaggaagcagagatggttgcaaaattgaaaaatgaggaatacgcagcaaagtatgttcgggctaagtatcaatactctaaagaaggggaatttgtctacaatattccagggttaccaaaatgaccgaatctatttttaaaattgtagagcaatttttacagcattctgatgaaaaattagaagagttgaatcaaaagaatagagaattaaagttagaagaaaatgaatcgtagaaaggagggagtatgcagaaaaaactgctcgtatggttattgccagttttatttggatggcaggtggtcgatagtacagaaataccatttgaactcacagcgcaagaagaatacgaattgactcatactatctatgatcagtattttcaaactatccctcaaaacccaaatgtttttcaaactgagaatctttattcggatgaagaattgactatagcaggtggacaattacagccgaaccaacatttttctattacggatgttctagtcaatagcaaaaaagaattggttttccaaatagatgacaagggttacattcttgcaagtaggcatctactatttgatgatgtaattgttacagaaactactgttgagcaaacttattggacaaaaaaaggtttcacattgttaacctcaccaattgctaacgaagctacggaaataaaaaatgatttacaaccctatcaagctgttatggtttctaaaattgtgacaacttccctaggtgattttgcctatgttacagataaaggttggattgcagtaaataatctttctaaaacggataatagagtagaagccgttcaagagttgttgactaacaaatattccaaagatactattggtatatatgtgaaacaattgtcaacaggtcaaactgcaggtgtaaatcaagagaaactattctattctgccagcattgctaaactaccaattctttattacgttcaagagcaactgaatgctggatatattgatttgactactaaagtgaaatatacagccgaatctatatccttcccaggagcttatgttgctggaggaagtggttcactgtcaaaaactcctgacaacaaagattattcagtggaagaattgatcaataagactgctaaagagtcagataatgtagctagtaatttactttcttattatgtagctaataaattcgattctaatttttatcaagtaataactgctaaaacaggtagtgagtggagtatggttacacgtgaaacttcagctgagattgcagggaaaatgatggaagccttatatattcaaaatggctatgtgctagaaagtttgttatctactcaatttgataatcaacgtatttcgaaagacatctcagttccagttgctcataaaattggcgatgcagacgatgtcaaacacgatgtagcgattgtttacgcagggtctccctttgttttatctatttttacagataaatcaaattatgatgagattacacaaattgcaaatgatatttacaggattttaaagtaaatgaaagatagatttttaaaagtgacactggatggtcacttttttgataaacataagaaagtactagtagccgtatctggtgggttagattctatgaacctattccatcttttatacgaatgcaaacaagtgttagggattgaacttggaattgctcatattaatcatggacagagagaagaatctgtcattgaggaaaaatatcttagacagttagcagaagaaagtaatgttcccttttatctgtcctattttgaaggtgttttttcagaagaagcggcgcgaaaatggcgttatggattttttgctacaatcatggagaaggaaggctacactgcactagtgacagcccaccatgcagatgatcaagcagaaactgtctttatgcgattgattagaggcgggcgtttacgtcacttatcagcaattcaaccgactcagccttttgcaacaggggaacttattcgaccacttttatcttttaaaaaggcagattttgaaaagctatttcattttgaagattgcagcaatgcagatttcaaatattttcgaaatagagtcagaaatgactatttaccaaagttaaaacaggaaaatcctaaaatcgaacttactctcaataatcttgcagttgatacaaataatctatttcaagcgctaagagatttgacacaggatttatccgttacagatgtgatgagttttcaacaacagacacctgcggtacaaagttatctattagaggaatatttggaaaaatttcctgatttacagctctctcgtccacaatttaatgaagtattacacatcttgcgttcaaaagctaactactatcatttattgaaaaatgattacatgctagaaaaggattatcatcgttttcaaatttataaaataggaccagagacggatagtcaaccagaaaaaatcatgatagaatcagaggggattttttcttacggttcatatattttttctctcaatcatcctttggaagaagcggatagtattttatattttcctacagaaaatccaattgtagtgaggagaaggcaggctggggataccattttaataaacggagtaaataaaaaactccgccgttggtttattgataataaaatctcacagaaagttcgacaaaatgcgcttattatcgagcagaatggagaaatttatggaattacgaatcttgttagcagtgatttgagtaaatcagtaaaaaatgatataatcaaagctaccttatatataaaaatgaaagagtagaacaactatgttggacaaagatattaagaaaattcttgtttcagaagaagaaatcgttgcaaaatgcaaagaactcggtcaaattctagcaacagactatgcagataagaatcctattcttgtaggaattttaaaaggttctatcccatttatggcagaattaatgaaacatattgatgcccatgtagaaacggattatatggttgtttctagctaccatggcggaacggagagttgtggtaccgttaagattatcaaggatttggacaatagtgttgcaggtcgatatatcatcttcgtagaggatattattgacactggtcgcacattaaaagaattgaaagaactctttgctttgcgtcaggcagcttctattaaaattgccactcttcttgataaaccagaaggtcgtgttgttgaaatcgagccagactacacttgctttactattccaaatgaatttgtagttggatttggcttagattatgatgaaaattatcgtaatcttccttatgttggtgtactcaaagaggaagtttacacaaaatagaaaaaggtttcctactatattatgaacaatcaaccaaataaaggatttataaaaaatccttttctcattattctcgttattgccactattgttacagcctttcaattttttaacgctggtcagcaagtagcaactcaagaaatcagttattcacaagtagtaactgaattgaaaaataataatgtatctgaaattacttatcaaccaaattcaagtgttattgaaattactggtaagtacaaaacagaacaggaagctaaagatgagttagcttcatctattaagttattccaagtttctagtaaagttaagtataaaaactttaagtcgctaattttaccgtcagaaacgaatttgtcagagctacaagctcttgcaaatgaaaatggagtaaaggttgctattaaacctgaaagttctaatggactatggttgaacattatctttaatttgttgccacttgttattgctggtgtattcttcatgatgatgatgaaccagggtggtggtggagcacgtggtgcaatgaactttggacggaataaagctaaagctttggaacaaagtaacatcaaggtacgtttctcagatgtagcaggtgcagaggaagaaaaacaagaattagttgaagttgttgaatttttgaaggatccaaaacgctttactaaacttggagcacgtattccagcaggtgtgctactagagggtcctccaggaaccggtaaaaccttgcttgccaaagcagtagcgggtgaagcgggtgtaccattcttctccatttctggttcagattttgttgaaatgtttgttggtgtcggtgccagccgtgttcgttcattatttgaagatgcaaaaaaagcagcaccagccattattttcatcgatgaaatcgatgctgtcggtcgccaacgtggtgtcggcatgggtggcggtaacgatgaacgtgaacaaaccctcaaccaactcttaattgaaatggatggttttgaagggaacgaagggattattgtcattgccgcaaccaaccgtagtgatgttttagaccctgcccttcttcgtccaggtcgttttgaccgtaaggtattggttggtcgtccggatgttaaaggacgtgaagcaatccttaaagttcatgcgaagaataaaccactagcagcagatgtagatttgaaattagtagcacaacaaacaccaggatttgttggtgcagatttagagaacgttctgaacgaagcagcccttgtagctgcacgtcgaaacaagactgtcattgatgcttcagatattgacgaagcagaagatcgtgttattgcaggtccatctaagaaagaccgtcaagtttcagccaaagaacgcgaaatcgttgcctaccatgaagctggtcatacgattgtcggccttgtcttgtcaaatgcacgtgaagttcacaaagtaacaattgttccccgcggtcgcgcaggtggatacatgattgcccttcctaaagaagatcaaatgcttctttctaaagaagatatgaaggagcaattggctgggcttatgggtggtcgtgttgcggaagaaattatttttaatacacagaccacaggagcatcaaacgacttcgagcaagctacacagatggcgcgtgctatggttgctgaatatggtatgagtgacaaaatgggaccaatgcagtatgaaggcagtcatgcaatgtttggtggacaaacaactcaaaaacatatttctgagcaaactgcatatgagttagataatgaagtacgtgatttgttaaatgaagctcgcaacaaagcggctgaaattattcagtctaatcgcgaaactcataaactaatcgcagaagcattacttaaatacgaaaccctagacagtgttcagatcaaatctctctatgaaacaggcaaaatgccagagaatattgaacgtgatgatgaagatgttcatcccctttcttatgaagaggtaaaagagaaaattaatacgaaagagtagtataaaaatactcttggcaagacattccctcactctcaaccactaaaataaccacaaagccttcgctaagtacataatcttggcgagggcttttttacatgatacacatcagaaacagggcatttacaagaaaaacgaatcaatagttatttatcacaatcttagaactataccaaatcactcccttcagaagcagaatgcaatatttgccatagagtatcaatagcaaatgtactttaaaaaagaaaaatcaaataaagtatgctagacaaaaatgtcctgtagaaagacagcacttttcgataaacttaaaccatcaacaaaaggagattaagtaatggaattcgaaaaagtgtacgcaagcgtcaaaggtattgtaaacaaggctcgaaaagagttttacattaaactatgggatcgagatgattgggaacaagaaggaatgatgaccttgtttgaattgttggaagctcaaccgtggctagttgatgaacaagttcaattatattgttattttaaagtcaagttcagaaatcgaatcaaagatcgtatccgcaaacaggaaagtcaaaaacgcaagtttgaccgtatgccacatgaagatatttacgaattatctcacgcaatacaatcaccgggattgataaacgatgaattattaatgttgagaggtgccttgagagattatcgaaaaaatctgagcaatgatcaacttgataaatacgaaaaattaattagcggacaatgttttaatggtcgccgtgaaatgatacgtgatttacaaattcatttgaaagactttcgctaaagctagttactaacatcacgttaatcgaattaagaaattgggcagaagcaccataaaaagttctgttcagtttctttttagataggttatagcacaggaagaaggaataggagaaaaaacaaagtatctacatagaactttcagtgtaaaaaatcccaaaaaaccggttgacaattgccaaagtagatgatagaataaatgagttgtctcttgagggactagttaacagaggaacgaaaaaagtttcgaaaaagtgttgacaagaccatcagaagatgatagactaatagagttgtctcttgagggactggttaacagaggaacgaaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgttgaaacgaatcaatcatatgtttcaagtaatataattaagtaaagactcgttagctcagttggtagagcaattgacttttaatcaatgggtcgctggttcgagcccagcacgagtcatatgcgggtttggcggaattggcagacgcaccagatttaggatctggcgctttcgggcgtgggggttcaagtcccttaacccgcatagaatggaaataggccggcttagctcagttggtagagcatctgatttgtaatcagagggtcgcgtgttcaagtcatgtagccggcattaggaaagattgcgaacgtagttcagtggtagaacaccaccttgccaaggtgggggtcgcgggttcgaatcccgtcgttcgctttgagaggccggggtggcggaactggcagacgcacaggacttaaaatcctgcgatggcaacatcgtaccggttcgattccggtcctcggcatgaagattataatagttagcacccttagctcaactggatagagtacctgactacgaatcaggcggttagaggttcgaatcctctagggtgcatcactcgcttaatggagacgttaggggagctttatttttaatagtatcgggaagtagctcagcttggtagagtacttggtttgggaccaaggtgtcgcaggttcgaatcctgtcttcccgattatattattttggcggtgtagctcagctggctagagcgtccggttcatacccgggaggtcgggggttcgatccccttcgccgctatatactcttgtttgctggacctttagctcagctggttagagctctcggctcataaccgagcggtcgtaggttcaagtcctacaaggtccatatatcggaggattacccaagtccggctgaagggaacggtcttgaaaaccgtcaggcgtgtaaaagcgtgcgtgggttcgaatcccacatcctccttttctactaccgcgggatggagcagctaggtagctcgtcgggctcataacccgaaggtcgtaggttcaaatcctgctcccgcaatttctttaagaatttggctcggtagctcagttggtagagcaatggattgaagctccatgtgtcggcggttcgattccgtctcgcgccattaatttaactttgtccaagtttattatcttgggcgcgtagctcagatggttagagcgcacgcctgataagcgtgaggtcggtggttcgattccactcgtgcccatattatattgatggagaattactcaagaggctgaagaggacggtttgctaaatcgttaggtcgggtaactggcgcaagggttcgaatcccttattctccgtagtgaacgagattatcgcttgatattctcgttttattgtatcttggtgaggatatattatgaataaattttcaaaattagtagtagttgtttctatctttttattactgtcattttctcttttgtttgtgactttctctaaggggttacaggtaccatatttaaataatatcgttagggttgttgtaacgccaattcaatcggttatttcagtacctactagatttttttctgagcagaaagatgtcttgacagatttgatgaacgcttacgaggaaaataaacaattaaaggaaactattatgagccttgaagggatggctgctgaaaatactagcttgaaagaagagaatgcatcgcttcgtagcagtttaggtgtggtatctgattttcctgaaaaacaacttattccgggatcagttttagtgaggactccttcatcgtggtcggagcatatttcaattaatattggtgagactagtggtgtgacatataatgcacttgtggttgctaatggtggattagttggcatcgtgagttcattgagttcagattcggcggttgttaccttatttacgaattcggatgaattcacgaagttacctgtgaaaatttctgttgattctaaagaaatttatggtattttatcgggctatgatgcagatacaaatagttttatcattaatcagttgaactcagctgatgaaattgcagtgggtagcaatgttgtaacgagtgatttggctggtgagactccggcaaatgtccaaattggtaaagttttatcggttaaatcaaatagtaacagtttaaatagagaagtatatgttgagccgacagctagtttttcaaacatttattcggttttagtggtaggtcaaacaaatgcgcaataaaatgatagaaatattcatgtttcccatcttgttctttattttattacttgatggacagatttcaacgttggtaacaaattggtcggtcggattatttactatttcaagtcatttggtacttatgttagctattttttatgctaactatgtatctcttggtttttcattattcatatttactttgctaggtttggtatatgatattagttatcttaatctgattggtattgctactacaactcttcctttagttttatattgcatctatttcttctttcaaggtgctgtcagcaagcgaggaattaatattttgattttactagtagctatttttcaatttgaatttattagttattcatttgctcgtatttttcatataacaaacttgtctgtatttatctttgtttttaataaattacttccaagtttactattcaatttggtcttatttttcgtgttacaaccattatttgagcgtttatttggaataacaaacaagacatagaaatgtaataattgcgtaatatacttacgcgatttttttgataaaatgagagagtcagaaagtatagaggagttatgttcggatatgaagaaaaaaatcttggctacaattatgttaagtacagtcgttctatctaatgctaattatgtagctgtgattagtgcgaatgatgtagatagtcagattgcaacaaaaaatcaacagattagtgagttgacagcacaacaagcagaagctcaacaacaagttgatgctattcaaggacaagttgatgcaattgttagtgaacaggcgaaattaacagaagaaaatactcgtttggaagcagaatcgcagacattggcggcagatattgagcgtttgtcagctgatattgtgtcacgtgatggtgctttaaaggagcaggcgcgtagtgctcaagttgatggttctgcttcaagttacattaatacaattttggattcaaaatcaatcattgatgctgtttctcgtgttaatgcaatgcgtgagattatttcagctaataaccgtatgttagaacaacaaaaggctgataaggaagcaattgttgaaaaacaaaaggcaaatcaagaggcaatcactactttggcagctaatcgccaaaaattggaagatgacgcccaagtattgcaagtgcgtcaggctgaattggaagctgctaagttaaatttggctgtgcagaaagctactgctgaagatgagaaaaattcattgttggtgcaaaaggcagctgcagaagaagcagctcgtcaagcggcagctcgtcaagcggagtatcaagcacaacaggcagctctagcacagcaacaagtagcctcagtatcagcaccagtcgtgtcaacgctagtagaaactacagtgactgaaacggttgcagcccctactcagacagtatcacaatctacaccaacggtaagcacacctacaacgtctacatcatcaggttcaggtagttcagcggcagcaaataatgcgcgttatgacgcttcatcttacccagttggtgagtgtacttggggagttaaatctcaactttcatgggttggtccttactggggagatgctaaacagtggttagcatcagcacgtgctgaaggttttagtacaggttctactccacaagtaggtgcgattgctgtttggacaggtggttattatgggcacgtagcggttgttacggctgttcaatcttcaacaagcatccaagttgttgaatcaaactacatgggtcgtcgttatattggtaaccatcgtggtggttatttcaatccaacaacgacttctgagggagcggtttactacatttaccctccatattaagaaattttcaaatagagcgtgtggatttgcgctctatttttgtttgaaaaatgaaggaaaaagggttaaaatagtaaaggtagaaatatataggaggctgtcatggcgtttactgacttaaaattgttcgctctttcgtcaaatcagaagttagctgaacaggtgtcgaaaaaaataggaattcctctgggaaaatcaagtgttcgtcaattttcagatggtgagattcaggtaaatattgaggaatccattcgtggaactcatgtgtatattcttcaatccactagctcaccagttaatgataatttaatggaaattttgattatggtcgatgctcttaaacgtgcatctgctgaatcagtaaacgtagtaatgccttattatggttatgcacgccaagaccggaaggctcgtgcacgggaaccaattacatcaaaattggtggctaatatgttgcagacagcgggggtcaatcgtttgttgacaattgatttgcatgctgcgcagattcagggattcttcgatattcctgttgatcatttgatgggtgctccattgattgcggattattttgagcgtcgtggtatggtaggtgatggctatgttgttgtatcccctgaccatggtggtgtgacacgtgcccgtaagttagcacagttcttgaagacaccgattgctattattgataaacgccgtagtgttgataagatgaatacatcagaagtgatgaacattattggcgatattaaggataaaacttgtatcttgattgatgatatgattgatactgcgggtaccatctgtcatgcagcggatgctttggcagatgcaggggcaacagctgtttatgcttcatgtacgcacccagtattgtcagggcctgctatggataacattagtaagtcagcaattaagaaattggttgttcttgatacaattgaaattgcagaagatcgcttaatcgataaaatcgaacatatttcaacggcagaattattagcggaagcgattattcgtattcatgaaaaacgtcctttgtcacctttgtttgaggcaagtcgtgttaaataggtatgagaagagtcaaatgactcttcttttttacatttattttcaaaatgtattataatagttttatatgtttttgaggtggcagaatggatttattgaatcgttttaataagaatttgaatcggattgaggtttcgatgattcgtcagtttgatcagtctatttcggatgttcccgggattttgaaactgaccttgggagagcctgattttacaacgcctgatcatgtaaaagaagcagctaaggctgctattgatgctgatcagagttattatactggaatggctggtcttttggagttgcgtcaggctgcagctgagtttgtggctgaaaaatataatttacactacaatccagaaaatgaaatcctctctacaatcggtgcgacagaagctctgtcagcgagtttagttgctattttggaggctggggatacagttcttctgcctgcccctgcctatcctggttatgagccgattgtcaatatggtgggagcagacatcgttgaaatcgatacgacggcaaatgattttgtattgacacctgagatgttggaagaggcgattattgagcagggtgataagctaaaagctgtcattctcaactatcctgccaatccaacaggtgtgacctactcacgtgagcagattcaggcttttgcggatgtcttgcgtaactatcctgtctttgtcctatcagatgaggtctatgcggagttgacttacactggtcagcctcatacttcgattgcggagtttttgccagaacagaccattttgattcagggattgtccaagtcccatgctatgacaggttggcggattggcttgattatgagtcaggctcccatcatcgctcaaattatcaagagccatcagtatcttgtgactgcagcgtcaactgctatgcagtatggtgcggttgaggccttgaaaaatggtaaggatgacgctcttccgatgcgggcggagtacgtcaagcgtagggattacatcatcgagaagatgacggacttgggctttaaaattatcaagcctgatggagcattttacatctttgcaaaaattcctgcgggttacaatcaagattcctttagcttcttgcaagactttgcgagaaagaaagcggtggcctttattccaggcgcagccttcggtcagtatggagaaggctatgtgcgaatttcctacgcagcaagtatggagaagattcaaacagccatggctcgtttgaaggaatatctagaagaaaatggaacgaattgaaaccaggggattagtcctatataatcggaattttcgagaagatgacaagctggtcaagatttttacagagaaggctggtaagcgaatgtttttcgtgaaacatgcctctaaatccaagctggtagcttctatccagcctttgacctatgcggattttatcgttaaaatcaatgatgatgggctgtcttatatcgaagattttcatcaggtacagccctttaagaatattaacggtgatattttcaagcttagctatgctacctatatcttggccttggccgatgcggccttgcaggacaaggtctatgacccagctctctttgcttttttggtcaagaccttggacttgatggagtcaggtttggactacgaagttctgaccaatatctttgaaattcagctcttgggtcgatttgggatcagtctgaattttcacgagtgtgctttttgtcatcgggttggcttgccttttgactattcctacaagtacagcggtgtcttgtgtccgcaacactatcaacaagatgagcgacgggcttatctggatccaaatgttccctatctacttgatcaatttcaggctatttcctttgatgagctggaaaccatttccatcaagcctgagatgaagcgaaaattacggttttttattgaccagctgtacgaggaatatgtggggattcacttgaaatccaagaaatttatagatgatttgtcttcttgggggcagattatgaaaccaagaacagaaaatgaggaaacagaatgaaacgtattgcagtagatgctatgggtggggaccacgcccctcaggcagtggtagaaggtgtcaatcaagccttggctgcctttccagacattgaaattcaactttatggtgatgaggctaaaatcaagcagtatttgacagcgacagagcgtgtcagtatcgtccatacgacggagaaaatcaattcagatgatgagcctgtcaaggctattcgtcggaagaaagaggcttctatggtcctagcgaccaaggctgtcaaggatggtcaggcagatgcggtcttgtcagctggaaatacaggtgctcttttggcggcaggcgtctttgtcgtcggtcgcatcaagaacatcgaccgtcctggtcttatgtccactcttcctactatggacggtaagggatttgatatgatggatttgggggcaaatgctgaaaatatagctcatcatctctatcagtatggtattcttggctcattttacgcggagcacgtgcgtggtgtcaaacaacctcgtgtgggacttttgaacaacggtacggaagataccaagggcacgccagttcaccaagaagcctataaactcttggcggaagacaagtcgattaactttattggaaatgtggaggcacgtgagttgctcaacagcgtggcggatgtggtcgtgacggatggtttcacgggaaacgctgtgctaaaaaccattgagggaactgcaaaatccatcgttggtcagttgactggctcaatcaagaatggcggtctgcgtgctaaattgggaggcttgctggtcaaaccaaccttgaaaaaggccttgggggctatggactataaaactgcaggtggtgctgtcttgcttggtctgaaagcacctgtcatcaaggcgcacggctctagcgatgcccagtcgattttctatacgattaagcagacgcgttcgattttggaggctggcattgttgaaaaatcagtggccaaattttcagtagtggaggagagtcatgactagagagcaggtctatcagcgggttgttgaattaattcaggatgaaaagggagaagattttcaagttcaacctgaatctactttggcagataatattgcagcagattcagtagaaatcatggaatttgttcttaatttggaggatgaatttcatgtagatgtcccagatgctgctattgagcattttgaggttctatctgatattgttgattttatttataaagaagtaaaaaaacgttcgtagtttacgggcgtttttctttgttttttcctaaacaaccgtaaatttgttgtgaatgcgaatattgtgtgttagaataaacgaaaagactagaatatttcacgaaaggcgaacattctcatgaaaacagaccttctctattcaggaaaagccaaagacatctacgctacggctgacagcgaccagattgttgcggtttataaggatcaggcgacggcttttaatggtggtaagaaagaacagattgtgggcaagggccggctcaataatctgatttcatctttgatttttgaaaaattgaatgaagctggtgtcccaacgcattttatcaagcgtttgtcggattcggagcagttgaataagaaggtggagattattcctcttgaggttgttttgcgaaatgtgacagctgggtctttctcaaaacgctttggggtggaagaagggataaccttatctactcctatcgtggaattttactataaaaaagatgagttggacgatccttttatcaacgatgaacacattgcctttctagaactggctagtcaggaccaaatcgcctatatcaaggaagaaacaagacgaatcaatgagttcttgaaggacttgtttgctcagattgggctgactttggtggacttcaaactagaatttgggattgactcttctgggcaaattttattggcggatgagttttctcctgataattgtcgtttgtgggatgcggatggcaaccatctcgacaaggatgtttttcgtcgggggctcggggaattgaccgaggtttacgaggtcgtattggcaaaattacaggaagtgaaataaggattggaagatatggcaaagcggatttttgttgagaagaaggcagcatttcagatcaaggcggaggctcttcgtaaggagttgactcataatttgcagttgacaagcctgtcaagtttgcggttagtgcaggtttacgatgtcttcaatcttgaggaggacttgttagagcaggccatcaagcatatctttacagagcaggtgacggacaaggttttgtcggatgaagaattaggtctggaaggtgcagtttattttgctattgaggctttgcctgggcagtttgaccagcgggctgccagcagtcaggaggcccttctcttattgggcagtcgtcaggaggtgcgtgtcaatacaggtcagctctatattttgaacggtgatgtgcaggaagaagaattagttgccatcaagaattatttgcttaatcctgtggattcgcgattcaaggatatggatgctcctttggtggctcaggagttttcggtatcagatactgtcattccaagcttggacttttttgatagctacggggtagaggaatttgcgtcttacaagcgtgaggctggtttggctatggaagtggaagacctgctcttcattcaggattacttcaagtcaattggtcgagtgccaactgagacagaactcaaggtcttggatacttactggagtgaccactgccgccatacgacatttgagacagaacttaggtctattgacttttcagcctcaaaatttcaaaagcaattgcaggcgacatatgacaagtacttggcgatgcggacagaattaggtcggacagataagccacagacgctcatggatatggcgacgatttttggtcgttatgagcgggcaaatggtcgtctggatgacatggaagtgtcagatgaaatcaatgcctgctcggtggaaattgaagtggatgtggatggcgtgaaagagccatggctcctcatgttcaagaatgaaacccataatcaccctacagaaatcgagccttttggcggtgccgcaacctgtatcggtggtgccattcgcgatcctttgtcaggtcgttcttatgtttatcaagccatgcggatttcaggtgcaggcgatattacccaacctctgacagctactcgctcagggaaattgccacagcaaatcatttcaaaaacagcggcacatggttattcttcatacggaaaccaaatcggtttggcgacaacttatgtacgtgaatatttccacccaggatttgtcgcaaaacgtatggagttgggtgccgtagtcggtgcagctccaaaggaaaatgtggtccgtgaaaaaccagttgcaggtgatgtggtcatcttgctaggtggtaaaacaggtcgcgatggtatcggtggagcaacaggatcgtccaaggtgcagacagtcgagtctgtggaaacagctggtgcggaagtccaaaaaggaaatgctattgaagaacgtaaaatccaacgcttattccgcaatggtgccgtgactcgcttgattaaaaaatccaatgactttggtgcaggaggtgtctgcgtagctattggagaactggcagacggtcttgaaattgatttggataaggttccactaaagtatgcaggcttgaacggaacggaaattgccatttctgaatcacaagagcgaatgagcgtggttgtccgtccggaagacgtagatgcctttatcgcagcttgtcgtcaggaaaatatccatgcggttgtcgtagccaaagtgactgaaaaaccaaacctggttatgacttggaatggacaaaccattgtggatttggaacgttccttccttgataccaacggtgtgcgcgtggtggtggatgctaaggtcgttgacagtcctgtcaatctaccagaaacacgtacaacatctgcccaaacactacgagaggacttgaaagaccttctatcagacctcaaccatgctagtcagaaaggtttgcagacgattttcgactcatctgttggtcgttcaaccgtcaaccacccactcggaggtcgtcaccagctgactccgacagaaagttcggtgcaaaagttgcctgtccaacagggtgtgacgacaacggcttcggtcatggctcagggctaccatccttacctagcagactggtcaccttatcacggagcggcttatgcagtcatcgaagcgacagctcgcttggtggcaacaggggctaactggtccaaggctcgcttctcctatcaggagtatttccaacgaatggataagcaggcagagcgttttggtcagccagtagcggctctgctcggttcgattgaggctcagattcagcttggcctgccgtctatcggtggcaaggactccatgtctggtacctttgaggacttgacagttccgccaaccctggttgcctttggtgtgacaacagcagacagctgcaaggttctatcacctgagttcaaggcgactggcgagcacatttattacctaccaggccagattttatcagaagacattgatttcaccttgatcaagtctaattttaaggcttttgaaaaatggcagagcgattatgtgattacggctgctagtgcagtcaagtatggaggagttctagaaagtctagcccttatgtcctttggtaaccaagtcggagcaagagttgagcttgccgactttgaaaccagcttgacaggtcaacttggtggctttgtcttcacatcgcaagaagacattccagatgctgtgaaaatcggtcaaaccactacagactttacactggttgtcaatggtgtcaacctttctggacaggacttgcaagtagcttttgagggcaaactagaagaagtttacccaacagagtttgaacaggcgacggagttgcaggatgttccagcagtcacaagttcagcggttataaaagcaaaagaaaccgttgaagtgcctgtagtttacattccagttttcccaggcaccaactcagaatatgattctgccaaggcctttgaacaggctggtgcaaaagtcaatcttgttccatttgtgaccttggatgcagagagcattgaaaactcggttgacactatggttgacaatattgctaaggcgaatattctattctttgcaggtggattctcggctgcggatgaaccagatgggtctgctaagtttatcgtgactatcttacgaaacgccaaggtccgctctgctattgaccaatttatcgaaaaaagaggcctcatcatcggtatctgtaatggtttccaggcccttgtcaaatcgggcttgttgccgtatggaaactttgaggaggcgggtgataccagtccaaccctcttctacaacgatgccaaccaacacattgctaaaatggtggaaacgcggattgccaatgtcaactcaccgtggttggcaggtgtccaagtcggcgacattcacgctatcccagtttcccacggtgaaggaaaatttgtagtgacggacgaggaatttgctactttgcgtgataatgggcaaatcttcagccaatacgttgactttactggtcagccaagcatggattctaagtacaatccaaatggatccagccatgccattgagggtattaccagtcgcaacggacaaatcatcgggaaaatggggcattcggagcgttacgaggacggtcttttccaaaacattccaggcaagaaagaccaaggactctttgtttcagcggttcgctattttacaggaaaataaatatgacatacgaagttaaatcactcaatgaagaatgtggagttttcggcatttggggacatccgcaggctgctcaggtgacctattttggtctgcatagcttgcagcaccgtggacaagaaggagcagggattttagccaatgatggcggacaattgtgtcgccatcgcggaacaggcctgattgcagaagtcttcaaaaatccagcagatttagaagccttgacaggaacggctgctattggtcatgtccgctatgcaacttctggctctgcttctatcaataatatccagcccttcctatttgattttgcagatatgcaggtgggtttggcacataatgggaatttgaccaacgcggtcagtttgaaggctgaacttgaaaaaaatggttccattttctcttcttcttctgacactgagattctcatgcacttgattcgccgcagtcacaatccagactttatgggaaaaatcaaggaagccctcaatactgttaaaggtggctttgcttacctgatcttgttagaagataaattggttgctgccttggaccctaatggtttccgtccactttcaataggcaaaatgaaaaatggtgcctgggtagttgccagcgaaacttgtgcttttgaagtagtgggggctgactgggtgcgagatgtggagcctggtgaaattgtcgtcattgatgattcaggaattcaatatgatagctatacaagagatacgcaactggctgtttgctctatggagtatgtctattttgctcgcccagattcggtaattcacggggtcaatgtccacacggctcgtaaaaacatgggtcgtcgtttggcacaggagttcaaacatgaagcggatatcgtggttggtgtgccaaactcctccctatctgcggctatgggatttgcagaggaatctggtttgccaaatgaaatggggctgattaaaaaccaatatacccagcggacctttattcaaccaacccaggaattgcgggagcagggtgtgcgcatgaagttgtcagctgtttcaagtgttgtcaaaggcaagcgcgtggtcatgattgacgactctattgttcgcggtacaactagccgccgcattgtccagcttcttcgtgatgcaggtgcaaaagaagtccatgtggctattggcagcccagaactcaagtacccgtgtttctatggtattgatattcagacccgtcgggagctgatttcagccaaccataccgttgaggaagtctgtgagattattggggcagatagtctgacctacctttctcttgaagggatgatagaggccattggtatcgaaaccgatgcgccaaaaggcgggctctgtgtagcctactttgacggagaatttccaacgcctctctatgactatgaggaagaataccttcgtagcctagaagagaaaacgagtttctacattgaaaatgtcaagtaaagacagatgtgtcaacgttacttgacagacctgtaaactgttgaaaggaatcaaaatgacaaataaaaatgcctacgcccaatcgggcgttgacgtcgaagcgggatatgaagttgtcgaacgcatcaagaagcacgtagctcggacagaacgcttgggtgttatgggagccctcggtggttttggcgggatgtttgatctaaccaaactggatgtcaaagagccagtcttggtatctgggacagacggtgtgggcaccaagctcatgctggctatccagtacgacaaacacgacaccattggtcaagattgcgtggctatgtgtgtcaacgacattatcgcagcaggtgcagagccgctttacttccttgactacattgcgactggaaaaaatgagccagccaagctagagcaggtagtagcaggtgtggctgaaggctgtgtccaagctggttgcggattgattggcggtgaaacggctgaaatgcctggtatgtacggcgaggatgactatgacctggctggctttgccgtcggcattgcggagaaatcccagattatcgatggcagtaaggtccaggagggcgacattctcctcggcctagcttccagcggcatccactccaacggctattcccttgtccgacgcgtttttgcagatgtttctggggacgctctgttgccagagctcaatggcagagctcttaaggatgtcctattagagccgacacgtatctatgtccagcaggtgttgcctctggtaaaagcaggtctggtcaacggcattgcccatatcacaggcggtggcttcatcgaaaatgttcctcgtatgtttgctgacaaccttgcagctgaaattgaagaagataagattccagtcctcccaatctttacagcccttgaaacatacggccaaatcaaacacgaagaaatgtttgaaatcttcaatatgggtatcggaatggtcctggctgtcagtccagggaaggtggagaaagtccgtgaattggtaggcgaagaagtctatgaaatcggccgcattatcactaaggaagacaagagtgtggtcatcaaatgaaacgaatagcagtgtttgcatcaggcaacggctccaatttccaagtcatcgcagaacagtttgaagtagcttttgtcttttcagaccgcagaaatgcctatgtcttggaacgagctgaaaaactaggtgtaccaacctttgcttttgaactaaaagagtttgcggataagcaggcctacgaagaagccattatccaactattagaccagcaccagattgacttggtggtcttggcaggttatatgaagattgtgggaccaaccctgttggctcaatatgaaggtcgtatcatcaatatccacccggcttatttgcctgaatttccaggagcccatgggattgaagacgcttggaatgcaggtgtggcagaaagtggtgtgacagttcactgggttgacagcggtattgacacaggacaaattatcaaacaagtccgagtgcccaggctggctgatgatatcctagaaacctttgaagctagaatacatgaagcagagtaccaactctatccagcagttttggaggagttaggggcagtgaaaaaataaggagaaatcatgacaaaacgcgcactaattagcgtatcagataaaaatggtattgtagaatttgcccaagaattgaccaagcttggctgggaaatcatttcgacaggaggcacaaaggttgctcttgataatgctggtgtagcgactatcgctattgacgatgtgactggttttcctgagatgatggacggccgtgttaagaccctgcaccccaatatccacgggggtttgctggctcgtcgggatgtggatagccacttgcaagcagccaaggaccatgaaattggcctgattgacttggtagtggtcaacctttatcctttcaaagagaccatcttgcgtccggacgtgacctacgacttggcggtggagaacatcgacattggcggtccgtccatgttgcgttctgcggctaaaaaccatgccagcgtgaccgttgtggtagatccggcagattatccgacggttttaggggaaatagcagagcagggtcagacgacctacccaacgcgtcagcgattggctgccaaggttttccgtcataccgcagcctacgatgctcttattgcagactactttaccaagcaagtaggcgaagacaagcctgaaaaattaaccattacttatgacctcaatcagcctatgcgttacggtgaaaatccgcagcaaaatgcggatttctaccaaaatgccctgccaacagactattctattgcagcagctaaacagttaaatggtaaggaattgtccttcaacaacattcgtgatgcggatgcggctatccgtattatccgtgatttcaaggaccgtccaactgttgtggcactcaaacatatgaacccttgtggtatcgggcaggcagaaactatcgagaaggcttgggattatgcttatgaggctgacccagtatcgattttcggaggcattgtcgtgctgaacagagaagtggatgctgcgacggctgaaaagatgcacccaattttcttagaaatcatcatcgcaccgagctactcggcagaagcgttagctattttgaccaataaaaagaaaaatcttcggattttagaattggcttttgacgcacaggatgcaagcgaagtggaaaaagagttcacaggtgttgtaggtgggctcttggtgcaggatcaggacgtggtggtggaaagcccagcggactggcaggtggttaccgagcgtcaaccgtccgagcaagagtgggcggccatggagttcgcctggaagtcttccaagtatgtcaagtccaacggcatcatcatcaccaatgacaagatgaccttgggcgtgggaccggggcaaaccaaccgtgtagcgtccgtccgtatcgctatcgaacaagccaaggatcgtttagagggagccgttttggcgtcggatgccttcttcccatttgctgataacgtggaagaaattgctgccgcaggtatcaaggctatcatccagccaggtggctctgttcgcgaccaagactccattgacatggctaacaagtacggcttgaccatggtctttacaggagtcagacattttagacattgagagttttggatttagctcacttcgtgtgagcttttttattcccgaacattaccctgctttttctatcaaaacccgtctatttttgctatactatttatagaaaatccgtttttgaggtgtaaaaaatgaaacttttggttgtcgggtctggtggtcgtgaacatgctatcgcaaagaaattgttagagtctgagcaggtagagcaggtctttgttgctcctggaaatgacggaatgactttagatggtatcgagttagtcaatatcgggatctccgaacattctgctataatcaactttgctaaggaaaatgacgttgcttggacttttgtgggtccagacgatgctctggcagcaggaatcgttgatgattttgaacaggcgggacttaaagcttttggccctagtcgtctagccgcggagctagagtggtcaaaagactttgccaaacaaatcatggtcaaatacggcattccaacagcagcctttggcacattttccaacttcgaagaagccaaagcctacatcgaagagcagggtgcaccaatcgtggtcaaggcggacggcttggcactgggcaagggcgtggtcgtggcggaaaccgtcgagcaggcggtcgaagcggcacgggagatgctcttggacaacaagttcggcgactcgggtgcccgcgtggtcatcgaggagttcttggcgggtgaggagttttccctctttgctctggtcaatggcgaccaattttacattctgccgacagcccaggaccacaagcgtgcctttgacggcgaccaaggtcccaacacaggtggtatgggggcttacgctcctgttccccacctgcctcaaagcgtggtggacacagcggttgacaccattgtcaagccgattcttgagggcatgattgcggacggccggtcttatctgggcgtgctctatgctggcttgattctgaccgaccaaggtcccaaggtcatcgagttcaacgcccgttttggcgacccagaaacccagattatcctgcctcgcctgacctctgactttgctcagaacatcgacgacatcctccacaaacgcccgacacagctgacttggctggatagtggcgtgacgctgggtgttgtcgtggcatcaaacggctaccctctggactacgaaaaaggcgtagagttgccagcaaagaccgagggcgacatcacgacctactatgcaggggctcgttttgcggaaaatagcagagcactgctttcaaacggcggtcgggtttatatgctagtcaccacagcagacaccgtccaagacgcccaagaaaaaatttactcggagctgaaaaatcaagataccacaggcctcttttatcggacagatattggaagtaaggcagtaaaataagggataaagaaaaggaaagacaagcatgaacattccaatttccatcatcatgggttctagttccgactggaaaaccatgaaaaaagcagccgatatgctggacaaatttggcgtagcctatgaaaagaaagtggtctctgcccaccgcaccccagacctcatgttccgtcacgccgaagaagcgcgtggtcatggcttcaaggtcattatcgcaggagcgggcggtgcggctcatttgccaggtatggtagcagccaagacaaccctacctgtcatcggtgttcctgtccaatcccgtgccctcagcggtgtggattcgctctattctattgtgcagatgccgggcggcgtgcctgttgcgactatggcgatcggcgaagcaggtgccaccaacgcagccctgacagctcttcgcattctctccattgaagatcaaaccattgcggctcagctggcagattttgccaaggaacaggaaaaaattgcggaggcgatgacagatgacctcatctaagacaatcggaattatcggcggcggtcagctgggtcagatgatggctatttccgctatttacatgggccacaaggtgatcacgctggatcctgcggcggactgcccagcctccaaggtcagcgaggtcatcgtcgctccctatcacgatgtggcggccctcaaacagctggcggagcggtgcgatgtcctgacctatgagtttgaaaatgttgatgccgacggactggacgcggtcattaaggacggccagctccctcaagggactgacctcctccgtatttcccaaaaccgcatttttgagaaggattttttggcaaaaaaagctggcgtgcaagtcgccccctacaaagtcgtcacatctagcctagacctagaaggactggacctcagcaaaaactatgtcttaaagacagccactgggggctatgacggacatggccagaaggtcattcgagaagaggcggacttggtagaagctagtcagttagctaactctgccgagtgtgttttggaagagtttgtgaatttcgacctggaaatctccgtccttgtatctggcaatggctccgactacaccgtctttcctgtgcaggaaaatatccaccgcaataatatcctttacaaaaccatcgtgcctgcccgtatttttgacgaacttgctgaaaaagccaaaaccatggccctgcaaatcgccgacaagctccatttagtaggcaccctctgtgttgaaatgtttgtggcagggcaagaaattcttgtgaatgaaatcgctcctcgcccgcacaattcaggacattattcgattgaagcctgtgatttttcacagtttgacacccatatacgaggcattttaggggagcccctgccccctatccgcctgctttcaccagcagttatgattaacgttttgggacaagacatggaaacagtccaaacctttcttcaagaaaaccctaccgcccatccccacttttatggtaaactagaagcgaagcacaatcgcaaaatgggacacgtgacggtgttgggggaagatgcggaaagtgtggaggagtttgaaaattaagattgctttctgattttttagttattaaaaagaggtttatgacatgccattaccacaaaaaattcaagaagagattaaaagatattgcaataatcacttgcctaataatgactggtatgagaaagagtttgattttatacatgatgtgagtctgaagaatagaattattagagagtttaaatcaattcggtacgcttacaagttatacgaagggataacggctgaggaggaacatttaatttttgaaattcgcagtcaaattttagcatatgcctctatatatgaagcagtagtagagtacgttttagagacatactatagtgatactcaagtttatgatgatttggtccatcaaaataatgtgatgacaaaaattgacataccagaagaaaagaggaaaaaattagaaagagaattaatccatctagtagataatggtacaaaaaatatagaaatacatacatttttttatcaaagaaagaggaaggcatcaacttcaattcgttttgatgcaaagtgtcgtgcagcagaggaattaaatataatttcaaaaatttatcaaaaaggaaataaagttgttgcagatttaccatccgatattattgaaatttatgagtacaggaatgcaatccatttgatagccgagcaacgtaaaaacattgactatgaattagaacttagtcaacgagcgtatagaagaatgaaaccttttatagaacaaataaaagataggctaattacagataataaattaataataaaaaacaccaaggataccttgactgacagctctattaaaaattgaaagactaactcaatatgatagggagaagatattaattcagttgaataaataaaaattttagggagatatagggtgttaaataaagagtggtatttcaaaaattttaatatggtttcagagttggatatctcaggagaatttatatatactggtatttccattgtaaataatatggatagaattgctccagagatgcctacggaattatttttggctttatacaacatttctgtaggagtcgaaagactacagaaaataatattagtgttgtgggagttcgatgaggttgattccatagaagacttttctgaaagtctaaagattcataatcaagttgaattacatagcagaattgaaaaagcgatcaataaaaagatttttagtaaacaagaatgccaatttttagaacttttaaaagagttttattctaatgcgaggtatgatagattttcagcagtggggaatagatgggaatatgaacttattagtaaatttttctctaataatcaaatcagttatgaagaatcagtttctgattctcaagtaattttaatcaacgatagtattaggaaattgatagggcgagtgctctctagaatagtaaaaaactactacctacttgtggaggaaggaagtaataaatcaggaacttattcatatgaactcagaaatgattcaaaagctcagaagatatttttacatatggagaatcgccgaggattaagttccataaaaatagatgaacggatagctttaagtgaaattcttatttatttgagaaatacatctgataaatcgtcatatttaaaatttattgagggaatatatcctcttgattttgataaaatggaaattagtagatatttatcaataattttactagaggatagaatccctcaagacttaattgatgaaattgaatatatttacgcagaaaaagatattaaggtaggagagcgaatagaaaacttagatttattaacaaaaaataatatgcaggttacattcgattatccttatttgaaggaagtatatataattttagaagaagtcaaaaaacaggaaagtattaacgatgatacaataagtaggttagaggagtctaactgttatattgacgatagtgatactcaagaaattatagaatctatcattgctgttgctcgccaatatcgcaataataaaattttgaaggaagagtttattaaagaatttagcagtcactacaaaactttagaagataattatacattaagttatattagtaacttgatgcaactagaagtaaggagcaaataaaatgattgaacgttattcccgcccagagatggcggctatttggagtgaagagaacaagtacgaggcttggttggaggtggaaatcctcgctgatgaggcttgggctgagttgggtgagattcccaaggaagatgtggccttgattcgtgagaaggcgacttttgacatcgaccgtattttagagattgaagaggaaactcgtcacgatgtggtggctttcacgcgtgcggtttcggaaagtcttagtgaggaacgtaagtgggtccactatggtctgacttcgaccgacgtggtggatacggcttacggctacctatacaagcaggccaacgacatcatccgtcgtgaccttgaaaactttaccactatcatcgccgacaaggctcgtgagcacaagtacacgattatgatgggccggacccacggtgtccatgcggagccaacgaccttcggtcttaaattagcaacttggtatagcgaaatgaaacgcaacatggagcgttttgatgtggcggccaagggcgttgaggctggtaaaatttcaggtgcggttggaaactttgccaatattcctccatttgtggaagaatatgtttgtggcaaattgggtattcgtccgcaggaaatttcgacccaggttcttcctcgtgaccttcacgcagaatatttctcagccctagccttgattgcaacgtctatcgagcgtatggcgacagagatccgtgggctacaaaaatctgaacaacgtgaagtcgaagagtatttcgccaaaggccaaaagggtagctctgctatgccccataaacgcaaccctatcggctctgaaaatatgaccggtctggctcgtgtggtgcgtggtcacttggtgacggcttttgagaatgtggctctctggcacgaacgcgatatttcccactcgtcagcggagcggattatcacgccggatacgaccattctcatcaactatatgctcaaccgttttggcaatatcgttaagaacttgacggtcttccctgaaaatatgaaacgcaatatggagtcaacctttggcttgatttacagtcagcgtgtcatgctcagcttgattgagaaaggcatgacacgtgaggaagcctatgatttggtgcaaccaaaaacggcgcaatcatgggacaatcaagtggacttcaagccccttctcgaagcggatgagcgtgtgactgccaaactcagtcaggaagaaatcgatgaactcttcaaccccgactactatgctaagcgggtggatgacatctttgaacgacttggattataaaaaaatcaaaattctttggattttccagagaatttttttgtttacttgcgaataaataggtgaaggggaaaacaagctccctccgctagacaatcattcgtaagaggatgagcagaaagtccagcctagcttctcagagttcgtatcaacatttcagcgcagtggttgattggcagattcgttcgcgtttcacgctccaaatctgacctaatcaactgtgcggggtgggaagacgaactctttagattggtcgagttctgtcccactcccaaaattttacgaatagataagtgtaggggaagcaagctcacaacttattcaaaaaaataagattttttcaaaaaaaagaaaacgatttgcgaataagtatagtgagagggaaaatccccctcaaggagatacacacttgaaaaaaataaatcattttcaaaatgatttacgaataaacaagtgtaggaaaaatgaaaggagaagaaggatgaaaaagaagttcaagattgtaaacaaacgtacaacgattgacctcgggattattaagtatagctaccgtcgtggtcgtcataccttgtaaatcaatcagtaaatcaaattgttaaagtaataggaggaaatagaaatgaacaaattttttaagaaaaataaacgtgtgacaatcgatctaggtattatcaaatacacctatcgtcgtggtcgtcatactttgtaaacagattagtaaatcatattatttgtaaatttttaaagaaaaaggagtaaaaatgaaacaattatttaagaagaataagcgcatcactattgatttaggtatcatcaaatacacttatcgccgcggtcgtcacactttgtaaaaagaacttgatagctaatttgatttagctatcaataagatgggaatttgttacagttcctatcttattgataaaaaggggaaacaatatgaatatgtttaggtcaatttttaagtcggtgatacatcgaagggatgttgctttgttctatgcttttgcgggtttgccaatcttagttcctatattgtccaaatttttggtaggcgtaaaggctgaatatacggataattttttagattttctaggagcagcattggcaacacaggacgggatagtgttacctgtattactgttatccttgattatttcagcagtctttagggacgagattgatagtggcattctatttttatataaagatctgaatagaacccgactttttaatgcaaaaatcattagtttagtggtgatgtatgcctcttatgtccttctaacagtgctgacaagtgcgattgcttattttggcttcttgaatgcttctggaaaagtagtatcggatgattggagtaatgtacagtccactttcctatctatttttgcaacaatttcaatcaatgttatcggtattttattggtttctacggtttctatcaaagccaaatccttacaggcagttttagcaggagttttttggtcactgtttacaacaactgcaccacttctcattggagttcgttatgttgtgccgaatggctatgctaagatgagtcttgatcagccactgcttgcatggtccttggtagtagctataacgacattttatactgttgctacctatctcaaaggtcgttcgaactttgaaaagctagaattttagaggtgttttatggtagtgcgctatatgaggccagttgctttatcgcttgctttgattgttttagcctccattagttatcttttggcaacatctttggttttgtttagctctagtcaatttctacagctagcctacctattttctattatggttggaatgccaatagggtttattctacttccatctatgataaccaagcgttatcagctttgtcaggagctatcggaagtgaagttcagttggaaaagctttgttttgctggctattgcaattttcttggtcaatttctggtttattcagagtgatgagtatgtgaatcaatttattattgcgacttgtgaagaattcttgttccgttatcttatctatcgtattctaaaaagtgaatatcctacttggctagctatgttggtcacttctctcttgtttggagttttgttgcatatgaattattccttgctggataatctaatcatccgaactccactaggtttattgttttctgtgttagctactcgttttggcttgcagtatgctatcggaggacattggatctacaatctgttggtttcgagatttccattttaattgtgagggtcatgatgatatttattctattattgagtctattttatatttgtttaacagttgctagttcgcaactattgctaagtctctctgttcctgttttattgttgttgacttatttgctaccgcccatcgtcaattcaatctgtatgggattacaaaaagataagtcttggaaagcgtggtcagcaggcattttcccaacaatgtcaatgatattttatgccgcttttgcctacattacgagtagcaatggtcagtgggagcagtttgctcaactgcatacagtttcagatgatgtcatgagtgtcgagctggcaggagaattgttagttccatcacaaatgctatttgttgccgtactatattatggtacagctattgccacttattttattcagcaggcaggtcgtaagaaagaaaaaggagctacttatgcttaaaatcaatcatttatcaaaacagtttgcaggaaatgaattttactcactaaaagatgtgagtttggagatcaataagggcgagattgttggtctgattggaaaaaacggtgctggaaaatccacgcttatgaaactcatggccaagtccctaaaaccaagttcgggaaccattacttataagggtacggatatttttagccaggataatttgttagcagactttgggattatgattgatccagtattctatccagaaatgactgttatggacaatctcaagttttatttggacctgcatgggaaaaaagacctctatccaaatattgagaagactttgaaattggtagagttatgggatgctcgcaatcggaaacccaagggattctcgttcggtatgaaacaacggacagctttggcgattgccttggttgcggagccagatttcctgatcttagatgagccttttgtgggcttggacccgattggtgttcaaaaattgattgatatcttgaagcagtggtccagtgagcgacaaatttccatgctgatttcgagtcaccaactaggtgagctggaggccttgtgcagccgctatgtctatatcgaatcgggagaattggcagatgcttttgaaggcaaatctcatccaagtgtgctcgtgcagttggacacgactaaaaacttagattctgtgaaggacttgctcaatgaccatgtggtgctagagggggaagtgttagagatttccactgccacacctacaagtgagctaaatcagatttttggtgtgttgactcgtcaagaattgattgtgaaactagaagtgaaagagaatcacttgaaagaaatctttacgaaagggtagtgagtatgaagcaaatttttccagctgtctttagaacgatttggaagcgaaaggagacgcaggtttatctcctattcactttgtttccttttatttatctagttacttcgtttattgaagggtcgaattttatgcagattcatgctggtgagggctataaagtcagccttgttgcctttacgaatatgatggtgagctcagcagatagtttcattcttcctagtttgaccctgtatttcttggctatatctgtctttaggaaagaagtagatgaacataccatgtttttataccgggatcttggacggaagcagattttctggtctaaatatttgggtctcttagcaacaatcgtcattttctatggtctcttctttgtaacctctgcatttgtacattatgttcgggtaatccatctaccttttggtagtccagctgtttttgaagctagtttggcagagagcttgagtaatgtattttgtattgtcgcttatttgctaaaagatattttatcgattagtttggcaactgctctttgtttgtatctgaaaaatattaccacaatgatcacaggatttttggtgacgattacgatgatgattttagcaattgttggcggtccagttgcgatgctttttccaactagttatatgactttggcgagcgaaggcctgacaggagcggggcttgcttatttaggagctatctgtgtcacaattatttacgtactcgtatttactaaaattgctgcgaaaaaattcaagaatttggagttctagttatgaataaaagactcgtcggagtgttgttgaagtcgctcaataaaacgatgttcttgtttgggatagttctgagtgcacttggggttggaatgggtttgttcctgccccagtttattggtaaattgctagatcaaacctatttgagcaatctattaacacggccagaattgctggcaggtttcatccttttctttgtatcggtctatgcagtacaggctctatctaattatttcatagggcgtagtggtagtaatgcactcaaacagttgcaacaatatatttatgaatccttgttgaccacatctgtaaaggacttggatcagtaccaatcaggtgatcttgctagtcgtttgactaatgatatgtcggttgttctgaacttcatcaccgttattcttccaaatttcttgatgaatggtttgatggttatggggtcaatttattttctgtggaccatcagtccgtggctcacgggtcttagtctcttcttgcttcctttgttgtcaatggttatgattccgatgaatcagcggttggaaggttactactctgcttaccaagagggattagggcaggtttctagtagaattagtcataaatttacaacgattcgtttgatgaaggcttttcagggagaaaagcatgaacagcgagagatgggcaagtcttttcagtatctgtcacaaacctttgagaaaatgattggactgtcagcggtgcaacataccttggttagtagcttaatgacgggatttattatcctgatgttgcttatagcggggatagaagtaaccaagggagtgatgaccatggctacattgacaacctttgtattgtacatgatgcaactgattgatccagtcacagacattgctgcttccctaaatgaactgacggagtttcatgcagtgtctaaacgtttggtagaattgctggaactgaataaggaagaacaggtagatacagagttggttgatgctactagtatccagttggaaaaagttcggttttcctatcatacagatccgattttgaatggagtatcggttagaattcctgagggagctcacgtggcgattgttgggccaagcggagccggaaagtcaacgatttttgccttgctgatgaaatattatcaagactataaggggaagattcggattggtcaacaatgtttaagtgatatttcaaccaaggagatgagaagattgatttccttcatacctcaggacaatactctctttcatgggacgattagagaaaatctattgtatggaaagaacgagtctgtgtctgaagagcgtattgcttatattctcaaggagttgggattgtctcctttagtagctgagttggaagatggtttagatactcggatttcagaaaatgggacaggcttgtcggaaggccaaaaacaacggttcagcattgcaagagccttactgctagaacatccgatttatttgctagatgaggcgacagcaagtttagatactgtcacagaacgtgtcattagcaaagcgattgaccgattaacagctggcaaaacaaggctaaccattgctcaccgtttgcatacggtgcgtgaggcagatgctattttggttttagataaaaatggacaagtagctgactacggtcatcaccagcagttagtggagagaaatcatctgtatcaagatttcttaagaggcttaccgcaagccagttagtgaatgggagtcaatggaccgaccagtctaagtctagggttacctaataataaaatggaatactgatgattacttgtacaatgaatagataggagaagagaatgaaacaaacaacatataccttatctttgggaggaagtgacagagagaactccagagtttcgaagatggaagaaaagtttgaaaaatatatggagggaatcgcagagcggttacagcaatctgggaagaagcgaattgacaaatggtttgttcatgtgcgaattgaggagtaaagtagctatgaccaaaattcacagacgtttttataaatagtgaaaaatagaatgaattctcttttagtttcccttaagtttggcgagttatactttattcaagctagaaatagcgagacttttactgaaatagtttcaatatcgtcatccgtaagagctaaagctcaaacggctggcatatcttttcaatccttatctctaagtcgcaagcgacaaggactagggattatataatctcctgagaatactggactcactgagtctggtattttcattttatgctataatggtttcatgacaaatcgaattttagatatggaacaaatgcaggacgaggaatatgtcgagcgtaccctgcgtccgcagaaattaaacgaatacatcggtcaggacaaggttaaggaccagctcaaaatctttatcgaggcagccaagctccgtgatgaagccttggaccatacccttctgtttggacctccaggtttggggaagaccaccatggcctttgtcatcgccaacgaactgggcgttaatatcaagcagactagtggtcctgttattgaaaaagcaggtgacttggtggcccttctcaacgacttggagcctggcgacgtcctctttatcgatgaaatccaccgtatgcccatggcggtcgaggagattctctactcagccatggaagacttctacatcgacatcatgattggggctggggaggccagtcgctccgtgcatttggagttgccgccttttaccctgattggagcgaccactcgtgcgggtatgctgtccaatcccctgcgggcccgatttgggattaccggtcacatggagtattacgaactggctgatttgacggagattgtcgagcggacggcggatatctttgacatggagattactcatgaagctgctattgagctggctcgtcggtctcgtggaactccccgtatcgccaaccgtctgctcaagcgggtgcgggatttcgcacagattatgggcgacggcctgattgacgatagcattacggataaggccctgactatgctggatgtggaccgagaggggctggactatgtggaccagaagattctccgcaccatgattgagatgtacggtggcggtcccgtcggcctcaacaccctgtcggtcaatattgccgaggagcgtgagacggtggaggacatgtacgaaccttacctgattcagcagggcttcctcatgcggacgcggacagggcgggttgcgacagccaaggcttacgagcacttgggttatccctatacggaaaaataatggcagagcagatgagacaagcagctcgtttatttggagactggcctgagacgattatctggacctgtttagaaggtgtcatgggagacatttatgttgatgacagccagttgccccagtcagccctagcactctacggacggcagagcttctttggttttttagctggccagccacatcgagacttgctaaaaatctgcgaaggtaaggatatgattctagtccctcaaaaccaaaactggtctgacttgatagaagggacttacggagacgggattcggtcctttacccgctatgctacgaaaaaggacactgagtttgaccttgggcatttacagaaactggttgatgacttgcctgaaagctttgatatgaaacggattgaccgtaatctgtacgaggcttgtctggtagaggaatggtcacgggatttggtgggaaattatatagatgtggaacaatttttggacttggggctgggctatgtcatcttgcacaaggggcaggtggtctcaggggcttcgtcctatgccagctattcagctgggattgagatagaagtggataccagggaagactatcgaggtctgggtttggcaaaagcctgtgcggctcagttaattttagcttgtttagaccgcggtctctatcctagctgggatgcccacaccttgacatccttgaaactggctgaaaagctgggctaccaattggacaagccctatcaagcatacgaatggagataagatgacaccgacatttatttgggatttggacggaacgctgttggattcctatgaagcgattttggcagggattcaagaaacctatcaagaatatgttcttccctttgaccgtgcagaagtaagaaagtttatccttcgctattctgtcaaggatttgctggtgcgtgatgcggacaagtacggtctggatagcgatgagctcaatcgtgtgcgtgcgacttccttgaaggaaaagaatacgcagattcccttgatggctggtgcggtggaaatcttaaactggactgcggaacaaggtattcaaaactttgtctatacccacaagagtgacaatgcttttcaggtcttggaggatttgggtgtccgtcaccatttcacagaaatcttgaccagcgattctggttttgcccgcaaaccaagtccagaagctctgctatttctcatcgaaaaatacggactggacaaggaaaatacctactatatcggtgaccgtttgctcgatgtagaaacagctgtcaacgcaggaattcacagtatcaacctgcaaattgatggtgtggagcagaattggaagattgtttctttattggacataaaacaaatattaacagataaatcaagtcataacaacctgtgaaaacgggtggcttgtacaccagctataagctgtttctctccagcgacgtctaaagatgtccgctgaacttcgttcaggttagtgctatgattacttgactaatgcccgtaacatcgggcttttgttttgttatggcttcaagctataataaaaatgagtccaaccgtctgttttaagaagagcatgatatggaatttgtgtaatatatttgatataatttaaaaagtatatttggaggtgtggtttatgaacgataaggaatttggacagcgtgtacgtcaattacgagaatctgctagtatgacacgtgaacagttttgtgacgatgaactggaactctctgtgcgccaattaactcgtattgaagcaggtgcttccaagccgactttttcaaagattcagtatattgcaactcgtttaggtatgggactttacgagcttatgccagattatgtatctttacccgaaagatattccaagctgaagtttgatgtgcttcgcaccccaacttatggtaatgaagatttggcggaaaagcgagatgccatgatgacagaaatctatgacgattattatgatgaattgcctgaggaggagaagatagcaatagatgcgattcaatcacgaattgatactttagagtcaggtacagcaggctttggaaaagagatactggaagactactttgaacaaatttttcgcaaacgaaagtatgaattgaatgatttgttgattgttaggctccatcttgaatatgttaggttatctagctgtgattcagaaatatttagacagtttttgaaaattatagagcatttacatgagcaaatcaatatcatcaactcaaatgatttatttgttttacgagacacgctattatcttgtgtaaatatattaggaagtaaaaaatattacgaaccaataccaaagatatttgacagtgtagataagattatacagtcgacacaagattttcagaaaaagcccattgttagtgtattaaaatggaaatatgcactttttgtggataaggatcgggatgaggcagaaaagcattatctagatgcggtgctatttgcaaaattgatagaaaatagagagttagaacagaagattgaagaagattggagagttgacaatcaataaagtgacatttttgtcctgttgaagaattgtgaaatgcattatactaaactcataaagattaaaggagattagtaacatgtttaactatttgaaattttttggtcgtcttggcggtaactggggaacatgggttgaagaataatattattaaaaagggagcgggaaagacatccatgatggctccgccctcacccacagaataatgaaaacgaacataaagccctcactaggtgtataatcttagtgagggctttgtggttaacgagttaatgatgttagtcatcgcgggaaaaactaactcactctactgacgagcaccccaaaatatgcgacaggcatgagtataaaaatacgactaaaattcggtagataagctctctaatttttagaaggagggaattatcatggatgttctctatcaatcttgtgcaggtattgatgtccatcaagccaatattgttgtctgtatcctacatggaccactcacctcaactcgtccaaagcgtgagatggctacatttgatacaacgactaaaggcctacgtgcttgccacgattttctcagtcaatttcatgtggaagctgttggtatggaaagcaccggtgtctattggcgacctgtctggcatgctctctgtgatgacttcgagctgatactcgctcaaccagcccacatgaaggctattccaggtcagaaaaccgacaagaaggacgctcactggattgccaaattaacacggattggtctgcttcctcggagtttcgttcccgatgaaaccattcaagaattgagggagttgaccagacaacgaaaacattatgtggaaagtcgcaatcgagaaacaaaccgtatccataaatttcttcagtcaggtggtatcaagctaacaacctatattgaagatattatggggctatctggtcgcaatctccttcagctactggttgatgggacgcctattacacctcgcattgttcatcaatccgtttataccagcttgaagaagaaagtgccgcagcttctggaagccttggacggttatttctctgaccatcatcgctttatgttaaagcagtccttagagatttatgatttttatcagaagcagattgagttgttggaagagcgaattactgtctatctatcacaatatgaaaaccatgtagaaacattggattccatcccaggcattgatgtcattacagcttctgttatcatttctgaggttggtgttgacatgagtcagtttccgacatctggacatttagcttcttgggctggactctgtccaggtaataatgagagtgctggtaaaaaacgaagtaccaagattcgacacggaaattcatatttgaagaaatgtttatgtcaagccgctttcgccgctaggaaccagaaaggaagtaccctagcagaccgattttatcagattcaaagtcggcgtggctcacaaaaagcaaccattgcacttgcgcatcaactattaaaaatagcctatatccttttaaaagaacagatgacttatcctgaatttttagcacaaaaaagactactagggacgagctagtagcctaatataaaaattgtttcactttgattctatcatagggagggagtttctgcattcttttgagttttcgtataagaactcgactggtcaaaaagagttcgtcaacaagtctttatttctagttgttgagctgaaacagtctattcccagacatcaatttatgtgagctgactgccgtcagcttatatctcccactttaaaaggtctcccagaccttttaaactcccacccccgtatagctccaacagtcagagtagtgactgttggaggttggagataaggcgaactctgttcgcatcagtcgtaatggtcagatttggagtgtaaaacacgaacaaatctaccaatcaaccactgcgctgagatgttgacacgaattctgagaagtgtgctggcttgagcccaatgtcattaagttaagcatttaaacaattaaagaaactattcccgtctgagcagttgatgacaagacgggaatagtttttgtatttagggcacacaaaaaggaaggtttttaacccaattttttaactattatgatattctataagtgaagcttacgggagcctggctttttatctttctttggaaggttcgattgggtcggatgatggataaatgtttggcaatgtaggtttctaattggaaggaagtaagttcttctctaagaaattttcgacaggcataaacagcgtctgaaaaacaaattttataagtctgttttaactttgatgttttaatggtaacgtgtgaggttagccatttacaaacattaaagttgataaagcgagcgtagatttcttgcagaatcccttccttctttttcgcatgaaaatgagtcaacccaatactgtattttaggtcacgaaaactggtctctatgccccatctgtaggcatagagatcttttaatttttctggtgaataatccgtatttgtcaccaaagtctcaaagaaacctggcttgatttcgagacgcaccatccgaaaatgaaggtcataaaactggagtggatccctttttcggctagagtttggtaaaaagtcaaaggatgtgtgattaggtaaacagcgatagtgattaggaaagtctcgatacagttgtttcatctcattggtttgttttcgacagatgtttaggtcaaatgcctcatcaaaacaaggggtgtcagggaggttaaatcctgacttcatagaatgattcccgacacgaatacgaataatataggaccaatttctttcttgacagtgtaccatgacattgtaggattcataccccctatccattatcaccagagcttgtttgaaagaagaggtcttcagcatgtcaataaaagctgctcgttcatcaagattcctagttagctgacttttccgactaaaatcttttttaggatgaagtaaaaactggtttgcggtggaaacgatgtcgttaatactatcaagtaaatgagctttaatctgatctagcatgacttttccccttttatttttagtgtactatagaaaaaactaacctaccacaaaacgtgataggttagttaacttaatgacattgggctttttgcccagcctcttttttgttatactagacagtatgtaggaggtggctatgttagaaaattggttaaacaccaaacaaggtcaggtgtttcattacaagatggaaaagattgagtatgccctagaactgctagggaatccccagtttgcagttccggtcattcatgtcgctggaactaatggcaagggatcgaccattgcctttatgcgcaagctatttcaggcacatggtatgcgtgttggaagttttgtatccccccacatggtgagtgtacacgacaggatttgtattgacagccagcccatttcagaccatgattttcagcactatttacagaaagtctacgatttggagcaggaaatcgccactcgttatgagccttttcgctattttgaggtcatggtgctcattatgttcctctatttcgaagctcaacaacccgatgtggcactagtagaggtgggcatcggaggacttttggatacgaccaatgtcgtggccccagccctaagcgttatcacctccatcggcatggaccatcaggatttattaggctcgactttaagggaaatagcagagcagaaagcagggattatcaaggaaagcgtacctgtcgtcctaggaccgctttctccagaaaccacagccatctgtcgccaaattgcccaagacaatcaagcacctgtctaccaatttggtcaggaattcacctataaagcaggacagttcagcaatccggacatcgacctgtcagaattggttttgggtctggctggccatcaccaagaagagaatgcggccgtagccctacaaacttttctactctatatgaccaatattcaaaaagacattcaacctcagttgattcaacaagcccttgcccaaaccagctggcctggtcgtttggaattggtagttcaagagccaaaaatctatttggatggagcccacaatgtccccgctatcgaacgtttgcttgaatttattcaggttcaagaagagcctgtcaccattctcttttcggcccttcggcgcaaggactttcaagaaatgcttgaattattagaagaaaaattgccacatactccacttgtattaaccagctttgcctatgatggtgccttggctgaggaaaaccgacaaggacgagattatgttgagaattatcagcaatttatagaagactggcaatctagcaagcaagggattttgattgttacaggctctctctactttatctcagaagttcgtcggatttttaaaaaatgaatatctttttgcgaataaataggtatgacacatgcagaaaaagtagcctttttaaaagaatttcaagagaacaaacgccatacttttcgccaattagaacagtttgcaaaaatttccagaactcccgataggaaatgacatcgggagtgctttttgatataataaggaaagcaaatccaaggagaagaaaatgacagaattagatgtagtttcggacgtagttactcatcctgaggaaacttatcggcgtagtcgtagagcatcacgtagacagcaagtgcaactgaatggtgaatttcatgaaagagtattaaagacaaagtattggccagctcttgtttggagcttagttttaagtgtttttagcgtagccaatccactgctaatgccatttgcaaccaatatacaaactcaaaatttatatgcagggatggcaatggcaaatggacaaatcccttatggtgatttctttggtacaagcgggttattattctacttacttgctttcttaggtcatctgggaggaactttcattatctttggaatcctccagtttatagcattactgatagcgggagtctatttctataagattgtagcttattttagtcagtcagaacacctagcgataagttctagtcattggttctatgtatttatttttgcacttggttttggagggatgtatgcagaaatgtttgctcttccgtttcttttgactagtgtgtggtttctggtccgctattttgaaaatgcagtgcgtgatgaggcatttatcctctacggaattgatgcggcattggtatttttaatttacccaaaaagtctgatcctttggttagttgcgggtctagttttatttatttttaatatccaacaccgccaagttactcgaggaatctatcaattattagcgaccatttttggttttcttctgattctatatgcggtaggttattatgcttttgaggcgcagattctggggacagctattcaacaaactttcctttataacttacagttagactttcaccattcctatctatatttagccttggcgattgtgtctgtatttttactcttatctggattctttaaaagtttcatccaaatggtgttttctttcaaacaaggaagacatacctatatcaaagttctcctattattgactttcttagttcaatgtgtctttattattgggaatgcaaactttcaatggagccaactcattcttcttttaccgtatggttttgcgatgtcagtcgtttacctgcgtgatgaggatgtagaagattatagtgggtatttgcgtcgtcaattctttcttccgttagctatttgcttgggtattatcgctcaacctgtttatctttatttggtacagggagatttgagaactgaccgtgaacaagttgccaattacattgatgaacaaacaaaagattcggataagatttatgtttgggataatagcgcaagcatctatctttcaagtcaacgtttatctgctgcaacgattactacagcagaaccctatctgaatactgacgacaataaaaatagcttgatgtatgacatcaataaaaatgaggcaaaatttgtagtcgtcaataagaatttgccaattctagatgaaatcaagacaaatttagaatcacagtaccagtctgttcagacaacggattactttacgatttatcaaaagaatgaatgattgctcaggcagtcattttttctttagcctatctgggaaaaggagggaaagtggatatgtggtataatggaaaaataagcattcgggaaaaattattaaagaaatgtaggagaaatgatgtcacatattattgaactaccagaaatactagccaaccagattgcggctggtgaggtcattgagcgaccagccagtgtggttaaggagttggtggaaaattccattgacgcaggggctagtcagattgaaattagtgttgaagaggctggcctcaaaatgattcaaattacggataacggtgaggggattgcccctgatgaagtagcgcttgccctccgccgtcacgccaccagtaagataaaaaatcaatcggatttgtttcgtattcgcaccctcggttttcgtggagaagccctgccctccattgcttctgtcagtcatatgatcattgagacagctacggcagactctgcacacggacttcatttggaggccaaaggtggtgtcatcgagaaagaggagccagttagtcgtccagttggtacgcagattactgtttcggatttattttacaatacccctgctcgtctcaaatatgttcgcagtcaacaggctgaattatcacatattgttgatgttgtaaatcgattgagtctagctcatccggaaatagcctttgtcttagtaaacgaaggacgagaattaattagaactgcagggacagggaaacttcgtcaggcaatttcagggatttatgggattgcttctgccaaaaaaatggttgaaattgaggcagaagatctggattttcagatttcaggttatgtttccttgccagagttgactcgtgccaaccgcaactacatttccatttttatcaacggtcgctatatcaagaattttttgcttaatcgagcgattttggaaggttacggcagtaagttgatggttggacgctttccgctggcagtcatttctatagaaattgacccctatcttgctgatgtcaatgtgcatccgaccaagcaggaagttcgcatctccaaggaaaaagaactcatgaccttgattcgagaggcgattagtcaagcacttaaagagcaggacttgataccagatgctcttgagaatttagctcagtcaagtactcgaccaaaagtaaaagcagagcaaggcaccttaccactcagagagccaaaaatctattatgatacgattaagcaagacttcttcttaaaaccagacgtggtcgctgaggatgtcaaacctctcgaagaggataggcaagagattgttgagtcgcctgtcgaaaatagacctacatctgttcaatttgcagaacgtcagtcggtggaatcagaagatcaggagcatcctaatctaagtgcaaaagaattggcaaaactggcagataaattagaccgggaggaaacatcgacatttccagagttagaatattttggtcaaatgcatgggacgtatttatttgcacaaggcaagacaggactttatatcattgaccagcatgccgcacaagagagggtcaaatacgaatactaccgtgagaaaattggacaagttgacaattcagctcaacagttattggtgccgtatatttttgaatttccgcagaatgatgcccttgacctcgtccacaaaatggatgcccttcgtcaagttggtgtcaacttggaagaatatggatctaatcaatttattctgcgtgaacatcctatttggatgaaggaagaggagattgagtctggcatttatgagatgtgcgacatgttgctcttgacggatcaggtgtcaatcaagcagtatcgggcagaactggccatcatgatgtcttgtaaacggtcaatcaaggccaatcatgctttggatgattattcggcgcgtgatttattgagacaattgtcttactgccaaaatccctataattgcccgcacggccgcccagtcttagtgcattttagcaaatcggatatggaaaaaatgttccgtcgcattcaagaaaatcacacgagtttgcgtgaattagggaagtattaacatagttgaaaaagttgacactttagcaaaggaagtatatgtacgactatattaaaggaattttaacaaaaataactgcaaaatacattgtggtagaaacgcaaggagtaggctatatcttgcaggttgctaatccctacgcctattcaggacaagtccagcaagaagtgactgtctatactcatcaggtgattcgtgaagatgctcatttgctctacggatttgctacagaaaatgaaaaatccgtctttctgagtctgatttcagtatcaggtattggtccaacaacagctctggctattattgctgttgatgataatgatggacttgttcgtgctatcgagcagaaaaacattacctacctgaccaaatttccaaagattggcaagaaaacagcccagcagatgattttggacttggaaggcaagtttgtcatgagcgaagaagcgggtcctgttcaacaagtagcaccatccagtgaaaatatcgcccttgaagaagccatggaagccatggaagcccttggttaccgcccagccgaactcaagaaaatcaagaaattctttgaaggcaccaacgacaccgcagaaaactacatcaagtcagcccttaaaatgctgatgaagtaataagatacaaaggacgtaaaggacaaagagaaaatagacggccgaacagaaattttgctagaaatttagttgtgagacctccgcaatgacaactaggtaaaaggcgagttttgacaaagccttttgccagatgtcaactgcgttattcggtgatatttaggattcagtttgacaatttttcaaagtatcgtagccgtgttcaactaacgtaccagtatgatggttaaaaagttttgttttgttactcaaagtttgagtcaacatttcagcgcagtggttgattggcagatttgttcgtgttccacacatcaaatctggcctaatcaactgtgcgggggcaggaagacgaattctttttctgcctgtcgaattctttcccgctcccactacagcaatcgctatttgcgacttgcctaggtaccttactaactcgccacaaaaataatgtcgatttttgtggctcatgtcgtgtccagatacaaagggcgtaaaggacaaagagaaaatagacggccgaacagaaattttgcaagaaatttcgttgtgagacctccgcaatgacaactaggtaaaaggcgagttttgacgaagccttttgccagatgtcaactgcgttactcagtgatatgtaggattcagtttgacaattttgcaaagtatcgtagccgtgtttcagtctgtttatcctgattcgtactttagttattcacgaaaaggagtttctatgtcccgttgtgcttgggtcaatcccaacaatccactttatattgcttaccatgatgaagaatggggcaagccacttcacgatgagcagtctttgtttgagttgctttgcttggaatcctaccaagcaggactttcctgggaaattgttctcaataaacgccaggcttttcgctctgcttttttcaactatgatattcaaaaggttgcggccatgacagatagcgagttagatagccttctgaccaatccagacatcattcgtcataaggcaaagctgtacgctacccgcgccaatgctcaggcctttcttcgagtacaggaggaattcggtacgtttgatacgtatctttgggaatgggttaactttacatctatcgacaaccctgtcaagtccttccgagaattgccgaccaagaacgacttgtctgagcggatttcaaaagatttgaagaaacgaggtttcaaatttgtagggcctgtctgtatttactcctatttgcaggctgcaggtctgttgaatgaacacgaagaaacttgcgagattggaaagaaattacgaactaattagatgagcgagcaatcgcaccctagacagaggaggaatatgaaagcagaactaatcgccgttgggacggagattttgacaggtcaaatcattaataccaatgctcagttcctttcggagaaatgtgcagagctgggaattgatgtttattttcatacggcagttggtgacaatgaaggccgtttattatcaacccttgaagtagccagcaagcggagtaatatggtcgttctttgcggtggtttaggaccaactgaggacgacctgaccaagcagaccttggcgaccttcttaggtagaaatcttgtgtttgatgagttggctatggcaaaattagaccgtttctttgccagtcgcccaggtcgtgtccgtacaccaaataatgaacgtcaggcacagattgtggagggaagtcaggcgctacagaatccagctggtttagctgttggtggtatgattgagcaagatggtgtaacctatattgttttgcctggcccaccaagtgagctcaaggccatgttttctgagagtctcttacctttactgtcccaatctcagcagcaactttattcgcgtgtcctacgcttttttggaattggcgaaagccagttggtgactgttttggcggacgtgattgataagcagacagacccaactcttgctccttatgcaaaagttggagaggtgactttacgcttgtccaccaaagcgaccagccaagaagaagcaaatctacgtttaaatcagttggaagaagacatcttacaacatgacaaactggcagactatttctatgcctacggagaggacaatagtttggtcaaaacggtagcgactcgtttggcggagaaaagacaaaccatcgctatcgtcgaacaggggacaggtggtctcttgcaagctgaattgagcctggctttggctgatcagccgtattttagcggaggaaaagtcgtcggtcagctagggatagaatcgggctggctatcagaggaagctgactgcattcggcaggagctgcaagctgatttaggtttggctgtgtctgtgcttatcaaaccggaatcaacagaggacaacgtacttgcaaaagtatacctcactttggctacgccctcgggtatttcccaaaaagagatagatttaggtggttattcgtggcaataccttcgccagcttgcttgtctgcaggcctgggattttgtacgaaacactttgtgaaatagcagatatttgctataatagtttgactaagaaaagaggagaaaatcattggctaagaaaccaggaaaaaaattagaagatattacaaagaaatttggcgatgagcgtaaaaaagcgttggatgatgccctaaaatcaattgaaaaagattttggtaagggtgctgttatgcgtcttggtgagcgtgctgagcaaaaagttcaagtcatgagctcaggtagcttatcaatcgacattgcgcttggagcaggtggctatcctaagggccgtatcattgagatttacggtccagagagctcaggtaagacaactgttgctctacacgcagtagctcaagcccagaaagatggtggtattgctgcctttatcgatgcggagcatgccttggatccagcctatgcggcggctcttggtgtcaatattgatgagttactattgtcacagccagactcaggggaacaaggtcttgaaattgcaggcaagctgatcgactctggtgcggttgacttggttgttgttgactcggttgcagcccttgtaccacgtgcagaaattgacggtgatatcggtgatagccacgttggtttgcaggctcgtatgatgagccaggctatgcgcaaactcggtgcatccatcaacaaaactaagacagtagctattttcatcaaccaattacgtgaaaaagtcggtgtcatgtttggtaaccctgaaacaacgcctggtggacgtgcgcttaaattctatgcatctgtccgtatggatgttcgtggaaacacacaaatcaaaggaacaggtgacaagaaagatcaaaacgttggtaaggaaaccaaggtgaagattgtgaagaacaaggtggctccaccatttaaagaagctgttgttgaaatcatgtacggtgaaggaatttctcgcacaggtgaattgattgagattggtagcaacctcggcatcatccaaaaagcaggggcttggtattcatataatggagaaaaaattggccaaggttctgaaaatgctaagaaattcttagcagataatccagcaatctttgatgaaattgaccgcaagatacgtgttcattatggcttgattgaagcagatggagttgaagaagttgcgaccgaagaagctcctgttgttgcggaagaaatccaagatgttatcctagatcttgatggcggtattgaattagaagattaattcctaacaaaatagatttaatattgaaccattgatgcatatctgttataggtgtgtatgaagttgtttagtataagaacgaaaaagtctggagattccaggcttttttctaataaaaaccgaatttttaccccaaaatttaaagtttttttaaaaaataggtctgcagaccgagggaatttatgatataatagtctataatgtgcttaataaaatgtagcaaaggagtgactacatgattaaaatttatactgtatctagttgtacttcttgtaagaaagcgaaaaattggttaaatgctcaccaattatcttataatgagcataatcttgcgaaggaagccattactaaggaagaaatcctaaacatcttaacaaaaacagagaatggtattgcaagtatcgtatcgtcaaaaaaccgttatgcaaagagtctggacttcgatattgaagagttgagtgtgaacgaggtcattgatttaattacctctaacccacgtattttgaagagtccaatcttgattgatgagaaacgacttcaagtgggctataaagaagatgatatacgcgctttcttgccacgtgcagtgcgcaatgttgaaaatgctcaagctcgtatgagagcagctctataagatgtacaaaaggactcttttggggttctttttgcgcattttttgagaataattaaaatttgtgatataatgtaaaaaatagggaaagaaggtgtaagtatgggatttaccgaagaaaccgttcgttttcgcctagatgatacagataaacaagaaatcagcaagacattgactagtgtttatcgttcgctggaggaaaagggctataatccgattaaccaaatcattggctatgtattaagtggggaccctgcttatattcctcgctataatgatgcccgcaatcagattcgtaagcatgaacgagatgaaatcattgaagaattggtgcgctactatttgaaagggaatgggattgacctctaatgagaataatgggattagacgtcggttccaagacagttggtgtagccatttcagatccgttaggtttcacggcccaagggttggaaatcatcccaatcgatgaagaaaagggcgaattcggtctggagcgtttgaccgaacttgtagaacagtacaaggttgataaatttgttgtaggcttgccgaagaatatgaataatactagtggtccacgtgtggaagctagtcaagcttacggtgatttattgactgagcgttacaaacttccagttgattatcaggatgaacgtttaacaactgttgcagcagaacggatgctgattgagcaagcggatatcagccgaggaaaacgcaagaaagttatcgataaattagcagctcagctgattttacaaaattatttagatagaacattttaaaggagattctaatggcacatcatcatgaccatgaacacgaccacaaccacgacgaacgtgaattgattactttggtagacgaccaaggtaacgaaacactttttgaaatcttattgacgattgacggtcaagaagagtttggtaagaactatgttctcttgattcctgcaagtgcagaagaagatgagaacggagaagttgaaatccaagcctactcatacattgagaatgagaatggcacagaaggcgatttgcaacctatcccagaagacgcaacagcagaatgggatatgattgaagaagtcttcaacagctttatggaagaggaataaaaaggtccgggtggacctttttatcatgagcatgaaaacaagaaagcgaattaaggtccagtggacctttttatcatgagctgaaaatcaaagagcgaattaaggtccggtggagtgaagcagtctgggggagactgtttcagcccgagttaagaaatagcaaggggaggaatgaatcatgagccagaaaatcaaaagggaggccagatgaaagatagttttacagaaagaagtaagaagctgagtgaggaattagagaggtgtctactggctgataaaaatattttggtcatattagacataatggatagactgaatttatcagattgctggctctgtgcgggaactatccgtaatttcatttggaatcaatacagttttgatgaagaaacagatgttgatcttgtgttttttgatgaaaatatttcttatgaagagacaatggaaatagaaagcaatttatatcaaaactatccagcctatcaatgggaattaaaaaatcaagtgtatatgcatatccatagtccgaatactaaaccgtatcaatcatcaagggatgcgattgaaaaatttccagaaagatgcacagcgataggtatttgtcgaacagaaagaaataaattagaaatatttgctccttttggattggatgacatttatgcttaccaagtacggccaacaccacatttcttagcggatcctaatcgcatggaattgtatcgacaaagaattcttaagaaacagtggaaaaagaggtggctatcgctaacagtaaaagagatttaactcccaccaagtaagtaggccaaaaacagtattttttataaactaaaacaatcaactacgggagattatgttatggaatttgaaacggtttgtttgaaggttagaaacttaggtaggctatattgctacttcaaagttaaatttagaacccatatcgaggctataattcgtaaacaggaaagtcaaaaatgtaaatttgatcgtctcctccatgaagatattcatagtttgattcaatcaccgagcttgggtaatgatgagttgctgatgttatggggtctcctgagagattatcgaaaaaatttaatcaatgaccgacttgaaaatatgaaaaattgataagcggacagagttttactggcagtcaaaaaaataattcgagacttacaaggatatttgaaaaaaaaacgttgatagttaactcaaataaaaaataagtaatgaagaatcctgaaataaaagttttgggattttttgaatttttgagtaaaaactcttgcaatggcaagtggaatctggtagaatgttctagtgccgtaaaaattacggctgtagctttgatgcaagaggttgcgacacgctcggttgcattgccacgcaacacgtgttggttttcttgtggagctagcctattatgttaaatagacgaaaaggagaaaaagatggcaaacaaaaaaattcgcatccgcttgaaagcgtacgaacaccgtacacttgatacagcagctgcaaaaatcgttgaaactgcaacacgtacaggtgctcaagtagcaggtccagttccacttccaacagaacgtagcttctacacaatcatccgtgcgactcacaagtacaaagattctcgtgagcagttcgaaatgcgtacacacaaacgtttgatcgacatcatcaacccaactcaaaaaacagttgacgctttgatgaaattggatcttccaagtggtgtaaacgtagaaattaaattgtaatcaagtcgcgagcaaaactcagaatcttgatttgagcatgaaaaacgctcgttaaaaactttttaaatacaaaataagaaaaggaatatttttctcatgacaaaaggaatcttagggaaaaaagtgggaatgactcaaatcttcactgaatctggtgaatttatccctgttactgtcatcgaagcaactccaaacgttgttcttcaagtgaaaacagttgaaactgatggttatgcagcagttcaagttggttttgatgacaaacgtgaagtattgagcaacaaacctgccaaaggccatgtagctaaagctaacacagctcctaagcgcttcattcgtgaattcaaaaacattgaaggcttggaagttggacaagaaattacagttgaaactttcgcagctggtgatgttgttgatgtaactggtacatctaaaggtaaaggtttccaaggtgttatcaaacgccatggtcaatcacgtggtcctatggctcacggttctcgttaccaccgtcgtccaggttctatgggtcctgttgcacctaaccgtgtattcaaaggtaaaaaccttgcaggtcgtatgggcggcaaccgtgtaacaattcaaaaccttgaagttgtacaagttgttccagaaaagaacgttatccttatcaaaggtaacgtaccaggtgctaagaaatctcttatcactatcaagtcagcagtcaaagctggtaaataataaggaaaggggaaatcagtcgaaatggcaaacgtaacattatttgaccaaactggtaaacaagctggtgaagtagttcttaacgatgcgatctttggtatcgagccaaaccaagcagttgtatttgatgtgatcatcagccaacgtgctagccttcgtcaaggtactcacgcagttaaaaaccgttcagcagtctcaggtggcggacgcaaaccatggcgtcaaaaaggaactggacgtgctcgtcaaggttctatccgttcaccacaatggcgtggcggtggcgtagtcttcggaccaactccacgttcatacgcgtacaaacttccacaaaaagttcgtcgcttggcacttaaatctgtttactcagaaaaagttgctgaaaacaaatttgtagctgttaactcacttgaattcacagctccaaaaactgctgaatttgcaaaagtacttgcagcattgagcattgattctaaagtccttgttattcttgaagaaggcaacgaattcgcagctctctctgctcgtaacatcccaggagttaaagttgcaactgcaacaactgcaagcgtacttgacatcgcaaatgcagacaaacttcttgtaactcaagcagctatctctaaaattgaggaggttcttgcataatgaatttgtatgatgttatcaaaaaacctgtcatcacagaaagctcaatgggccaactcgaagcaggcaagtatgtatttgaagttgacactcgtgcacacaaactcttgatcaagcaagctgttgaagctgcattcgagggtgttaaagttgcaaatgttaacacaatcaacgtgaaacctaaaacaaaacgcgtaggtcgttatgtaggtcgcacaaacaaagtgaaaaaagcaatcatcacattggctgctgattcaaaagcgatcgaattgttcgctacagctgacgctgaataatcaaaggaggaattaacgtgggtattaaagtttataaaccaacgacaaatggccgtcgtaacatgacttctttggacttcgctgaaatcacaacaagcactccagaaaaaagcttgcttgttgctttgaagagcaaagctggtcgtaacaacaacggtcgcatcactgttcgtcaccaaggtggcggtcacaaacgtttctaccgtttggtagacttcaaacgtaacaaagatggcgttgaagcaatcgttaaaactatcgaatacgatccaaaccgttcagcaaacatcgctcttgtacactacacagacggtgttaaagcttacatcattgctcctaaaggtcttgaagttggtcaacgcatcgtttcaggtccagaagcagatatcaaagttggtaacgcacttccacttgcaaacatcccagtcggtactgttgttcacaacatcgagttgaaaccaggtcgcggtggtgagttggttcgtgctgctggtgcatctgcacaggttcttggtcaagaaggtaaatacgttcttgttcgccttcaatcaggtgaagttcgtatgatccttggtacttgccgtgctactgttggcactgtaggtaacgaacaacatggccttgttaaccttggtaaagcaggtcgtagccgttggaaaggtatccgtccaacagttcgcggttctgtaatgaaccctaacgatcacccacacggtggtggtgaaggtaaagcaccagttggtcgtaaagcaccatctacaccatggggtaaaccagctcttggtttgaaaactcgtaacaagaaagctaaatctgacaaacttatcgttcgtcgtcgcaaccaaaaataatctattcttagttacatagcattctatatcatccgccaactcggtagggtttgttatggactgactattccagcacctcagtttgattgaaatgccagtttgacgcagtggttgattgcagtttctagtagcttagctacgtcgaaacttctaatcaactgtgcgggggcaggacaacgaacacggtaactggggttctgtccatctcccaagccgctgtggtacatattttaaaggagaaaacactaaaatgggacgtagtcttaaaaaaggacctttcgtcgatgagcatttgatgaaaaaagttgaagctcaagcaaatgacgaaaagaaaaaagtaattaaaacttggtcacgtcgttcaacgatcttcccaagtttcatcggttatacaatcgcagtttacgatggacgtaaacacgtacctgtatacattcaagaagacatggtaggtcacaaacttggtgaatttgcaccaactcgtacttacaaaggtcatgctgctgacgacaagaaaactcgtcgtaaataatttaggaggaaaacacaatggcagaaattacttcagctaaagcaactgctcgcacagtacgtgtttcacctcgtaaatcacgtcttgtcttggataacatccgtggcaaaagcgtagcagacgcaatcgcaatcttgaaattcacaccaaacaaagctgcaggcattatcgagggagttttgaactcagcaatcgctaacgctgaaaacaactttggtttggaaaaagctaacttggtagtcagcgaagcattcgcaaacgaaggaccaacgttgaaacgtttccgtccacgtgcgaaaggttctgcttcaccaattaacaaacgcacagctcatatcactgtagttgtggcagagaaataaggaggtaaaaacgtgggtcaaaaagtacatccaattggtatgcgtgttggcatcatccgtgattgggatgctaaatggtatgctgaaaaagaatacgcggattaccttcatgaagatcttgcaatccgcaactttatcaaaaaagaattggctgatgcgtcaacatcaacaatcgaaatcgaacgtgctgtaaataaagtaatcgtttctatccacactgctaaaccaggtatggttatcggtaaagctggtagcaacgttgatgcgcttcgtgctcaattgaacaaattgactggtaagcaagtacacatcaacatcatcgaaatcaaacaacctgatttggatgcacaccttgttggtgagtcaatcgctcgtcaattggagcaacgtgtggcattccgccgtgctcaaaaacaagctatccaacgtgcaatgcgcgctggtgcaaaaggtatcaaaacacaagtttctggtcgtttgaacggtgcggatattgcccgtgcagaaggctactcagaaggaactgttcctcttcatacacttcgtgcggatatcgactacgcttgggaagaagctttgacaacttacggtaaacttggtgttaaagtatggatctaccgtggtgaagttcttccagctcgtaaaaacactaaaggaggtaaataacaaatgttagtacctaaacgtgtaaaacaccgtcgtgaattccgtggaaaaatgcgcggtgaagctaaaggtggaaaacaagtagactttggtcaatacggtcttcaagcaactactagctcatggattacaaaccgccaaatcgaagctgcccgtatcgctatgacgcgttacatgaaacgtggtggtaaagtttggattaagatcttcccacacaaatcatacactgctaaagctatcggtgtacgtatgggttctggtaaaggtgctcctgaaggttgggtagctccagttaaacgcggtaaggttatgtttgaagtagctggcgtttctgaagaaatcgctcgcgaagcattccgccttgctggtcacaaattgccagttaaagttaaattcgtaaaacgtgaagcagaataaggagaagacatgaaacttcaagaaattaaagattttgtaaaagaacttcgtggcctttctcaagaagaacttgctaagaaagaaaacgaattgaagaaagaactcttcgaacttcgtttccaagctgctgctggtcaacttgagcaaactgctcgtttgaacgaagtgaagaaacaaattgcgcgtatcaaaactgtgcaatctgaaactaaataatagattgggaaaggagaatttcaatggaacgcaataatcgtaaagttcttgttggacgcgtagtatctgacaaaatggacaaaacaatcacagttgtagttgaaactaaacgtaaccacccagtctatggtaaacgtattaactactctaaaaagtacaaagctcatgatgaaaacaatgttgctaaagaaggcgatatcgttcgtatcatggaaactcgcccactttcagctacaaaacgtttccgtcttgtagaagttgtggaagaggcagttatcatttaatcaacctgaaaggagaaaattgacatgattcaaacagaaactcgtttgaaagttgctgacaacagtggcgcacgtgaaatcttgacaatcaaagttcttggtggttcaggacgtaaattcgcgaacatcggcgacatcatcgttgcttcagtaaaacaagctactcctggtggtgcggttaaaaaaggtgacgttgttaaagccgttatcgttcgtactaagacaggtgctcgtcgtgctgatggttcatacatcaaattcgatgagaatgctgcagttatcatccgtgaagacaaaaaccctcgcggaactcgtatctttggcccagtggcacgcgaattgcgtgatggcggtttcatgaaaatcgtttcattggcaccagaagtactttaatcaaatagttttaggaaatttgttacaaactaacgaagtctgtgacgggtttagtaaactagaaaacaaactaagtcccctggttaaatcactaaccagggtgcccattagggcgtaagaaattataggagaaatcaaatgtttgtaaaaaaaggcgataaagttcgcgtaatcgctggtaaagacaaaggcgttgaagcagttgtcgtaacagcacttccaaaagtaaacaaagttattgttgaaggtgttaacatcgttaagaaacaccaaaaatcaaacagcgaaaaccctcaaggcgctatcgttgaaaaagaagctccaatccatgtgtcaaacgttcaagttcttgacaaaaatggtgttgcaggacgcgttggttacaagtttgtagacggcaaaaaagttcgctacaacaaaaaatcaggcgaagtgcttgattaatcacgaaggaaaggagaagtataatggcaaatcgtttaaaagaaaaatatcttaatgaagtagttcctgctttgactgaacaatttaactattcttcagttatggctgtgccaaaagttgataagatcgttttgaacatgggtgttggtgacgctgtttctaacgctaaaaaccttgagaaagctgctcaagaattggctttgatctcaggtcaaaaaccacttatcactaaagctaagaaatcaatcgccggcttccgtcttcgtgagggtgttgcgatcggtgcgaaagtaactcttcgtggcgaacgtatgtatgaattcttggacaaattggttacagtttcacttccacgtgtacgtgacttccacggtgtaccaactaagtcatttgacggacgtggtaactacacacttggtgtgaaagagcaattgatcttcccagaaatcaacttcgacgatgttgataaaactcgcggtatggatatcgttatcgttacaactgctaacactgacgaagaatcacgtgcattgcttactggccttggtatgccgtttgcaaaataagagggagagaataaatggctaaaaaatcaatgatcgctaagaacaaacgcccagctaagttctctacacaagcttacacacgctgtgaaaaatgtggacgtccacactcagtttaccgcaaattcaaattgtgccgtgtatgcttccgcgacttggcttaccttggacaaattcctggcgtaacaaaagcttcttggtaagataagatgtgagagcgtttagcaaccaacgcaaagataggagattttacgacgaagtttacttctaggaaaatctatcttctttgctaagcttgtagctcgaactcaattaaaacatgatactaagggcgtgacggacaaagtgaaaataggaactctagcgaagaacgcttgcgttctagatagagttatctttttcacacaggccgtagcccgagttcaaatgttaggatgcaatagcatcatactagcaaattcaaactttgcattgcctatcaggcacacattaactagcaagtgatctaatcaaactgctagtaagaggagaaacaacaaatggttatgactgacccaattgcagattttttgacacgtattcgtaacgctaaccaagcaaaacacgaagtgcttgaagtacctgcatcaaacatcaaaaaaggtattgctacaatccttaaaaacgaaggttttgtaaaaaacgttgaattcatcgaagatgacaaacaaggcatcatccgtgtattcttgaaatacggaccaaacggtgaaaaagttatcacaaatttgaaacgcgtttcaaaaccaggtcttcgtgtttactcaaaacgtgaagatattcctaaagttcttaacggacttggtatcgcaatcatctcaacatcagaaggtcttttgactgacaaacaagctcgtcaaaagaacgttggtggtgaggttatcgcatacgtttggtaatcttttagcttccaatttcgtcatgtgcctgtgttagagcgtcttgacatactcaagtatggtctgcgtcgctctgccttgtcacatttagaaattgaaacctaaaagcatgatacaaatgcgagaggaccagttcttcgtgcgtgttcaaatctgacttactgattatttggtatcatgcaaccaaactagaacaagattcactaattgaacacgcctacaactctttgaaaaaagtgaaaagtgtttcagaaatccttaccttgttcgtcgtaaacgtctgaactttctctggccttcggtcaggaaagtcctagtcgttctgacgagggtgcgtctgcgaaatcaaagacttcggacttaccgcttatttttcttcgagttgcttaacggctttgtatcttgttcaccccgtgaaaactagtcgcttgacggcttgataatttaacaggagaattaaaaaatatgtcacgtattggtaataaagtaattacattgcctgctggtgttgagcttgctcaaaacaacggcgtggtaactgtaaaaggacctaaaggggaattgactcgtgaattcccaactgctattgaaatccgtgtggaaggtgcagaagtaactcttcaccgtccaaacgattcaaaagaaatgaagactattcacggtactagccgtgctaacctcaacaacatggttgttggtgtttctgaaggcttcaaaaaagaacttgaaatgcgtggtgtcggttaccgtgctcaattggctggtaacaaattgacacttgctgttggtaaatcacatccagatgaagtggttgcaccagaaggtatcacatttgaagttccaacaccaacacaaattgtcgtgtctggtatcaacaaagaagttgttggtcaaacagcagcttacatccgtagccttcgcgctcctgagccatacaaagggaaaggtatccgctacgttggtgaattcgttcgccgtaaagaaggtaaaacaggtaaataatagcttgctgaggtggctggaccacctggctgactatttctcaaattgtttcgtaagaaacagaatcatacattaagaggtgaatattgtgatttcaaaaccagataaaaacaaaatccgccaaaaacgccaccgtcgcgttcgcggtaaaatctctggaactgctgctcgcccacgtttgaacattttccgttctaatacaggcatctacgctcaagtgattgatgacgtagcgggtgtaacgctcgcaagcgcttctactcttgataaagaagtttcaaaaggtactaagacagaacaagctgttgttgtaggtaaactcgttgctgaacgcgcggtagctaaaggtatttctgaagtggtctttgaccgcggtggatatctctatcacggacgtgtgaaagctttggctgaatcagctcgtgaaaacggattgaaattctaatagggaggacactaagaaatggcattcaaagataacgcagttgaaattgaagaacgcgtagtagccatcaaccgtgttacaaaagttgttaaaggtggacgtcgtcttcgttttgcagctcttgtggttgttggtgaccgtaacggtcgcgtaggtttcggtactggtaaagctcaagaagtaccagaagctatccgtaaagcagttgaatctgctaagaaaaacatgattgaagtaccaatggttggtacaacaatccctcacgaagttcgctcagaatttggcggcgctcgtgtattgttgaaacctgcttcagaaggttctggggttgctgccggtggtgcaactcgtgccgtaatcgaattggcaggtatcgcagatgtgacttctaagtcacttggttcaaacacaccaatcaacatcgttcgcgcaacagttgaaggtttgaaacaattgaaacgtgctgaagaagtggctgcacttcgtggcatctcagtttctgatttagcataagaaaggagatactcatggctcaaattaaaatcactttgactaagtctccaatcggtcgcaaaccagaacaacgtaaaacagttgttgcacttggacttggtaaattgaactcttcagttgttaaggaagataacccagctatccttggtatggtgaacgctatctctcacttggtaactgtagaagaagttaaataatctaacaaatagactaagtcgcatagagaaatctttgcgacttctagtccattttacatatttacatacagcgagtttgtggaggaagactcttgtacttcacaggcgctagcatataaaagaggagaaataataatgaaacttcatgaattacaacctgctacaggttctcgtaaagtccgcaaccgtgtaggtcgtggtacatcatcaggtaacggtaaaacatctggccgtggtcaaaaaggtcaaaaagctcgtagcggtggcggtgtccgcccaggttttgaaggtggacaaactccattgttccgtcgtcttccaaaacgtggatttacaaatatcaacgctaaagagtacgcaatcgttaaccttgatcaattgaacgcttttgaagatggtgcagaagtaacaccagttgtgcttatcgaagctggaatcgttaaagctgaaaaatcaggaattaaaattcttggtaacggtgaattgacgaagaaattgacagttaaagctgctaaattctctaaatcagctgaagaagcaatcacttctaaaggtggctcagtagaagtcatctaagaggtggcagcctatgttttttaaacttttaaaagatgccttaaaggtaaaattggtacgtagtaaaattctatttactatctttatcctttttgtcttccgcgtaggaacccacattacagtaccaggagtaaacgcaaagagtcttgaggccttgtcaaaccttccgttcttgaacatgttgagtttggtttcaggaaatgctatgcgtaatttctcagttttcgcactaggtgttagtccttatattacagcttccatcattgttcaacttttacaaatggatattttacctaaatttgttgaatggggtaagcaaggtgaagttggtcgtcgtaaactaaatcaagcaacacgctacatttctttggtactggcatttgttcaatcgattggtattacagcaggctttaatgctttgtccggtgcaaaattgaccaatatgccattaaattggcaaacatatttgttgattggagcgattttgacaacaggttcgattattgtaacctggctgggggaacagatttctgaaaagggctatggtaatggtacatcaatgatcatctttgcaggaattatttcatcgttaccaggaacttttcacgagatttacattgatcgctttgttaatattgaatcaagtcgtttgggggaatcagcaatctttgttgctgcactcgtcgtattaatattctttgttgtgtattttacaacttttgtacaacaagcagaatataaattaccaattcaatatacaaaacgtgcacaaggagcaccttctagctcatatttacccctgaaattgaatccagcaggagttattcccgtaatctttgcaggctcaatcactgcagttccaacttctttgattcaatatttcgcaagtcaaaataagagtgccgggtggttattgacggttcaggaatactttgattattcaactgctaaaggtatgattgtatatgcaggtttaattattgcctttacattcttctacacctttgttcaagtaaatcctgagaagactgcagaaagccttcagaaaagtgcagcctatatccatggagttcgtcctggtaatggcactgaacagtttttgtcaaaattattgacaagattggcagtaatcggtgcactcttcttgagttttgtagctttgctgcctatccttgcgcaaaatctctttgggctttcttcaagcattgcgttccttggtacaagtttgattatcgtaatctctacaagtatcgaaggcatcaagcaattagaaggctaccttcttaagagaaaatatgtaggtttcttagaaattacagaatagaatataggttgacctagtcaaccttctattttgtttttagataagtttgtcaataatggcaaatttatgtgaaaacaaaataaggagtttgtcatgaatcttttaattatgggtttaccaggtgctggtaaagggacacaagcggccaagattgttgagaaattcaatgttgctcatatctcaacaggagatatgttccgtgcagcaatggccaatcagactgaaatgggtattcttgccaagtcgtacattgataagggtgacctcgttcccgatgaagttactaatggcattgtcaaagaacgtttggttcaggatgacatcaaggaaaaaggctttttgcttgatggctatcctcgtacgattgaacaagcccatgccttggatgaaaatttggctgacttaggaattgagttgcaaggtgttatcaatattgagattgatccttcaaaattggtagagcgtctcagcggtcgtattattcataaagaaactggagagactttccacaaagtattcaatccacctgttggagactacaaagaggaagacttctatcaacgtgaagatgacaagccagaatctgtcaaacgtcgtttagaggtcaatatcgcacaaggacagccaatcattgatcattatcgtgcaaaagggctggtccatgatattgaaggtgaccaagacattgaccttgttttccaagcaattgatacagtactatcaaaattgcaataaactaatagatttggcttgcattttttatacaaagatgataaaatagtctagtctgacttataattgttacctctgtgttcagaggacatcaaatcgatatttagagaggggttacttttgcatggcaaaagaagatgtgattgaaattgaaggcaaagtagtcgatacaatgccaaatgctatgtttactgttgagttggagaatggacaccaagtccttgcaactgtttcaggtaaaatccgtaaaaactacattcgtattttggtcggtgaccgcgtaactgttgagcttagtccatacgacttgacacgtggacgtatcacataccgctttaaatagtcgaaatacttggagggattaaacatgaaagtaagaccatcggtcaaaccaatttgcgaatactgcaaagttattcgtcgtaatggtcgtgttatggtgatttgcccagcaaaccctaaacacaagcaacgtcaaggttaagaaatagaaaggagaaaacatggctcgtattgctggagttgacattccaaatgacaaacgtgtagttatttcattaacttatgtttatggtatcggtcttgcaacatctaaaaaaattcttgcagctgcaggtatttcagaagatgtacgcgtgaaagatttgacatcagatcaagaagatgctattcgtcgtgaagttgatgcaatcaaagttgaaggtgacctccgtcgtgaagttaacttgaacatcaaacgtttgatggaaatcggttcataccgtggtatccgtcaccgtcgtggacttcctgtccgtggacaaaacactaaaaacaatgcccgcactcgtaaaggtaaagctgttgcgatcgcaggtaagaaaaaataaaataggaggtagaaaaattggctaaaccaacacgtaaacgtcgtgtgaaaaagaatatcgaatctggtattgcacatattcacgcaacatttaataacactattgttatgattactgatgtgcatggtaacgctattgcttggtcatcagctggtgctcttggtttcaaaggttctcgtaaatctacaccattcgcggctcaaatggcttcagaagctgctgctaaatctgcacaagaacacggtcttaaaacagttgaagttaccgttaaaggcccaggttcaggtcgtgagtctgctatccgcgctcttgctgccgctggtcttgaagtaacagcaattcgtgatgtgactcctgtaccacacaatggtgctcgtcctccaaaacgtcgccgtgtataatcatacattccatacacagcttttcgtttaagagggagtaagaaatgattgagtttgaaaaaccaacaataacaaaaattgatgaaaataaagattacggcagatttgtaatcgaaccattagaacgtggttacggtacaactcttggtaactctcttcgtcgtgtacttcttgcctcacttccaggtgctgcagtaacatcgattaaaattgatggtgtactccacgaattcgacacagttccaggtgttcgtgaagatgttatgcaaattattcttaacatcaaaggcattgctgtaaaatcttatgtcgaagacgaaaagaaaattgaacttgatgtagtaggtccagctgaagtaacagcaggagacattcttacagatagtgacattgaaattgtaaaccctgaccattatctctttaccattgctgatggtgccacttttaaagctgttttgactgtcaattcaggtcgtggttatgtaccagctgaggataataagaaagatgatgcaccagtgggaacacttgctgtagattctatctatacgccagtgaagaaagtcaattatcaagttgaaccagctcgtgttggtagcaacgatggttttgacaaattaacacttgaaatcaacacaaatggcaccattattccagaagatgctttaggtctttctgcacgtattttgatggagcacttaggtctcttcactgacttgactgaagttgcaaaatctgcagaagtgatgaaagaagctgaagtggcttcagatgatcgtatgcttgatcgtacgattgaagaattggatctatctgttcgctcatataactgtctgaaacgtgcaggcattaacactgtattcgacttgacagagaaaactgagccagaaatgatgaaagtgcgcaatcttggtcgcaagagtcttgaagaagttaaagttaaattggctgatcttggtctaggattgaaaaaagataaataatataggaggaaatcatggcataccgtaaactaggacgcactagctcacaacgtaaagcaatgttgcgcgatttgacaactgaccttttgatcaacgaatcaatcgttacaactgaagctcgtgctaaagaaatccgtaaaacagttgaaaaaatgatcacacttggtaaacgtggtgatttgcacgcacgtcgtcaagcagcagcatttgttcgtaacgaaattgcatctgaaaactatgatgaagcaactgataagtacacttctgctacagcacttcaaaaattgttctctgaaattgcacctcgttatgcagaacgtaatggtggatatactcgtatcctcaaaactgaaccacgtcgtggtgatgctgcaccaatggcaattatcgaacttgtataagatcatcaattttgttgagtgttatgatgatggaatcctattctgattcttagtctagctctggtctaccgctgagcttgtctcagcggtaacactcatcatgttgattggacgcttgtttacgaaattactctaagatagaataatttcgtaagcaggcgtttttattttactcaaaaattttgatatactggaggcatacgaagaaaatatacaatctccgattagtatgcctctcagtttttcgccaaatttcataaaaaaatccaaaaaaccggttgacaattgccaaagtagatgatagaataaatgagttgtctcttgagggactagttaacagaggaacgaaaaaagtttcgaaaaagtgttgacaagaccatcagaagatgatagactaatagagttgtctcttgagggactggttaacagaggaacgaaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccatataagcgggtgtagtttagtggtaaaactacagccttccaagctgttgtcgcgagttcgattctcgtcacccgctttgaacatagttcatacccaaacttggtttgggcgcgtagctcagatggttagagcgcacgcctgataagcgtgaggtcggtggttcgattccactcgtgcccattatatggtccgttggtcaaggggttaagacaccgccttttcacggcggtaacacgggttcgaatcccgtacggactatattattcggaggattacccaagtccggctgaagggaacggtcttgaaaaccgtcaggcgtgtaaaagcgtgcgtgggttcgaatcccacatcctccttactattatcgcgggatggagcagctaggtagctcgtcgggctcataacccgaaggtcgtaggttcaaatcctgctcccgcaatttctttaagaatttggctcggtagctcagttggtagagcaatggattgaagctccatgtgtcggcggttcgattccgtctcgcgccattaatttaatattatatttcggagagatagcgaagaggctaaacgcggcggactgtaaatccgctccttcgggttcgggggttcgaatccctctctctccatacctttacgggcatagtttaaaggtagaactaaggtctccaaaaccttcagtgtgggttcaattcctactgcccgtgttatatggcgggtgtggtgaagtggttaacacatcagattgtggctctgacattcgggggttcgattcccctcactcgcctattttaatattggggtatcgccaagcggtaaggcaagggactttgactccctcatgcgttggttcgaatccagctaccccagttcaactatatgccggcgtggcggaattggcagacgcgctggactcaaaatccagtgtccgcaaggacgtgccggttcgaccccggccgccggtatagtttaaaagacaaggtttctaagccttgtcttttgttttatcttttctattgctctttttcaagttgccaaaaaattccattttctaaaaaatatcgtccaatttgttcgccaatgtcttttgtttactagggtataagtgggaatatgtatctattgtagtcgtgatagaggcgtgtccaagacgttcttttacgactagataatcttccccttgattgataagtaaagacgcgtgagagtgccttaaatcgtgtattcgtatcttttttagatagtcgttcctagccagtatctgcttaaattttttatcaatcatattttttgtcattggtagtggtgtgctttgaattacttgaaggttttctgtatctgttgtaaattctttaagtaagtctttttgtttttctttccagtctgcaagcattcttgctaatttatgattgattgtaatacgtctggtacctgctctagtttttgtactattgatatgatttgtaccgttaacaaagtatgctgtttttgtgatgtgaatgctattagtgattaagtttatatcgtaccaagttaacgcaactatctcgcccaatcgcatgccagtaaaaaaggcaatcgtaaagaataggtcataacttatttcatcacttgtaataagttttctaaattcgttaaattcttctacattccaaaaatttatagttggcttactaataggtaattttcttatattttcaactggatttttatctatcaatgactttcttacaccagtatcaaaaatctttttgagaagtatcattattttattgactgtattatgacttaacgtagagctatcgttttgcttttttggctttattttgagatactctcgaaattcaaaaatgtgctcataagataatttgtttaagtttgtatttatgaagtaaggtttgatatgtcgctcatagttgtttctttgtgtgctgatataactgatttttctgttattttgtcggtcttcttcctcaagtatatcgaagagcatatcggttgttaccaaaaaatcaaaacgtttttcttttaactcaacaacacggatatattgttctaactctaaagcttctttcttggtcttgaaacctttacgaatgattcgtatccgctttttggtaactgggtggaagccgtcagaaatatcaacagtccaagttccattttttgctttcttaactgtcatgatgagcacctaaagaaacgtcaaaaccaagtaattcagtagcgatagaagcagggatagttccgacacgcttattttgataaaccctaaaccctcttgctattagaagctctttcccctgtctgatgatacgtttagaagttccttcagagaaaccaagggcaactaggtcattcttatttacggttgctatcattgaacactttcctttcttttgttataatctagttagttaatttttagaggcgacttgttttcaagtcgtctttttttgtccccataagggagaactattctgctctcgaatatattgctctatatccttttcatcattatcagttagccttgacaagccctcttttagtagaccttgaatgtagtcctctgccttttgaacatcataggcttgatattttgctgtatagacttttgccaatgtcttcgcaacttgtttctctgtccaagcctctgactgccgtaatgtaggcttagttctctcaacgctcaaaacagtctgattttcggtctttagatagtctagccaccacttgaccttttttcttctccaacgattagtatctgtcgcatttggtttcacaaaacgatagtgaccattgatagcttcaaaatagatagatgacagaggacgctttagaaacaattgctctgcaataatattcgccttatcctgccaacatctaagttccgcacgaatccatgagggatattctacaagctcttgcttgctaagttgttccatacgtttgttgtagatacaccattgttgattacctctggaacctatagcaaccgtctctccaactcgttctccattttctaagacagatttctcatgatactcaaaatgctttgctttcgagatacataaacctttcttgcaatagtcatatactcgctgaacatctaaactaccgtcaaatatgtcgtgagcaatatctaagcgagtaaaattaaccgaatactgatacaaccgacctatcaaagctatccaattattttcgttaccgtccaaaaattcttcatattggcgacaaccttgcccttttaattcgataaaaacccccattgaaggtctatcctcattaaagtacactttaatctcagaacaagcataatgtcgctggtacttgtttattccccaattatttaatgtgaaatcttctaaaggaattaaaagaatatcagttaaaacactttctggaggaatatttttaacggttactgcaaaataatcaattctgactgtattcatagggttatgctcctagaattttaatgtcctcacatactaatttaacacctgcccagttacttcgtgccatgttccaagctaaacgaactttcggcttaaccaactcaatcggaacattcaaaagtgattcattttgagcgagcgtagcaaccttatctacattacctacaatttctaggttgatagctttcaagtcatcagtagaaattcccatttcagttagaactttcactttatcggcatcaagggcagtacaagtgattttcgtaacttcttcagttttgattttctcgccattaacctcgttatacctattatttactttagcagatagaataacaatttttttaggcacttcaaactgtgtcatatccaaatcaagttgcccaatcttaagggtagtatctgtcatattgtaagtcataataattactccattttctattcaaaaagtcgtatcctacacgaaaagcgactaaatcccttctcccacaagggtttcaatgacttcggtataaccaacaagccgtaaccccttacgtatcaagggtttagagtacatttcatgtatgtgtgcaccccctattagagtacatttcatgtatgtgtgcaccccctattagtaatgggggtatttttctgacctcctgcaaagcagtcggttggctctttctcctagcgaaaagaggaacgctccgctcgattctgccccctgggcaatcgtcccccctatttcgctagtccgaaagaccgtcattattagtttggcagtatatttctaactacctgtaaaaaatcttgttttgttttaacatcgacgaacgggacgatagttagtacaggctcaacagaatttaaaccgtcagcataaaagagtgcttcgcctttcctgtctgaaattgtaggaacattttccagttcacacatactaaaagccattttcaatcggtcgtcccctatatttccgaggtataaaactgctgatatttggtttctaagttcaacaggaatattctctgcatttgggtcttgggtactaaggcagaggtggcaacctgcctgccgtcctttgcgtgcaatcaagcctaagttttgcagaatttcattccatagctctttaccttgtttactagaaccacaactatcacgaatagaagcaagctcatcaataaacaaaaaattaggggtcattcctaaatcataggcatcagcatttagcgaactgttctgcttgataacctcaaaacgttcatccataatttttacaaactgtcttgatagctttgctagtgaagtaggagaagagcctactgaaatttgttttcccagttcttcttggaggagtgccccaagagcatataagtcagctcctttaccatcaacgatagctagataagtatcaataccgcaccctttggcaagtgcattaaataagtaccattgtagagctattgtcttccctgtacccgtccttccatatactcctaaattagtattctgttttagagaaaattgctgagtattggatagtttaactattggcgtaggtatgtcttcaaaaaaatctctagtcaatgtttggctattgaatatatactgctcaatttcttctatctttccaagtttataaataacatggtcaggaaattcatatttggatagtagaggtagacccaaggttggaacaagatattcttcaagattttttagaagttttaaaaacttattcccaaacaatggtacttcgaccattacaatatcattgggcaagatttcaaagtttaatgttgcactattggttactacattatcactttcttcgtataaatttaggccaatcagcatatcaaatagagattctctaacatacagtatattttgaatttttgatataaaaacagacttaaaaaatttttcaatagaacaaattattccaataaatatcaatgaaagcactgatttaatagggattgagtatggagaaacccaagtgtttatcaataacattcctaaaaataaatccattccgactctgctcaaaaacaatcttttagaggttattatataaggattaaacctcactcgtactgcatgattcagcttgattagcttcattatctgtccctccgtggtcattttctgataaataacccaacaataacaataaaagtggaataactaaaaaacctccagctacaaacaaagtatcaaaccacggagacatcgtccctttcatctggaatataatatacaaagaaataactagagcaggataggttatgttgaacataaatttataaattttcataataatttcctttcataaaaccaaagggggaggggttagctcccccttatatcactaagcctcaattattgaggtgtaaaaagaagtttccctgtagccttggtaaatctctttgttcatcaagctaatcctaaattcatcagaaatacggtgtttttgacgattaagaataatgatgttttctgctaacttcttcaaagtaggctcatagattaccccttcaattggcaaattttcctttaaaaaatctctggattcatcatctaaggtaaagtttactgatttgtctgaattaaagctctgtactcgcttaattccattgatatttggcatttccattccttcgctaaggaaaatatctttaaatgttttcatctatttatttctccattttttattttgttgttacagtcaatattcttaaataaattggtgaagctctagccttcattagtattctcctctttgtgtttatgtataaatgtagtatcagtcataaacaacagtaattaagctacagttcctcaatgttaccatgagaaactgtaatcctctactgcattatttctttatagtaagcaaaaataacaagttttagaacatatgacaatctaacttgcctaaccatttcagaagtcataaattctttttgataactttccaatgatgtaataatagaattttccaaaaaaaatcttacagacaaggttccaacatccttatcctttggaatagacgaaatcgaatgtttcatttcattatctaatttatgccaatctttcaaacttaaagatttcgttttttcaaaagcctcttctaaaacacttgatgcagaggcttttaaaatcaaagtcactgaagttgcccctaattcattgtcaacttctttcaaatatgattttgttgcatgttctaaattttctatatcttgttcatttattttagcgtctaacttttcctgaatcactgcttgtattgattctaaccaatacttcgcttcgtaagatagacgtactccaaggtgtgagcgcatttttactcctattattagttttgttgtatttgatatacacattctatcatctatatttgcagaaatcaagtaaaaacaccaaaagatttccaaaaataaaatattctatttcctttacgacagaatggacgtcttaaaatattgatttaataggctttgagtagttgtaagttcttaagtatcaaactcaaaatccagtgtccgcaaggacgtgccggttcgaccccggccgccggtatagtttaaaagacaaggtttctaagccttgtctttttgttttgaggttataaaattttcagttgagttactaaaaattacttaatgttttgttgtataataagttatataagcaagaggaggagccattatatgaagacactttatcattatacaacagttgaaacattgcttctgatattaaattataaaacattgagattcaaaagtttactttatgttgacgatccattagaaccttcaacttcagactttggtaatctaggtggatttaagtatgtgtcttgttggactgatactcctaatagtattccacaatggacaatgtattctgataatatgacaggagtgtgtataggaattagttttgacaaagaaactgatgtctttttaacggaaaaattttctttatctgaatcttctgaaccaattgatatggtaaatgcattacatcctttaaaatcaggcttattagttacaaataataaatatgtgccttctttggaacaaataaggtatactgatgatgtttcattgatcactcctcgagtagtttcttcagatgataaatccacaactattaatttagcttcaaatggtatctataagacaactgattggagttttcaaaatgagcaaagattttcttttcaaatttttccattaccaatagatttagttttggaattaatgaatgcaaataaaggagatttgactgaaataattaatagttttatttctgttaaacctaaagaatactttgatttagatttaaatccgactatattcagtaatatgacaattacgtttggtaaaagatgctctgctgaagataagttgaaagtatcaaaatttttagaggataataaattccatattcctttatttgatagtactgtaaatataaagccttaaattaggtcatctaatttatctgctaaatctttttgcttgcttggatacaagtgagaataggtatcgattgaagttgttataaaagcgtgtcctagcctttctttcacaactaaataatcttcccctcgatttatcaatagagaagcgtgtgagtgcctaaaatcatgtatgcgtatctttttaagagccgcatcacgttcaagaatttttttgtactgcttttctattgaattttttgtaatcgtaatgggactactttgaaacactgacatcgaacagacattagctagagggctggctggactacagttacgaattgaacaaattattctggctcataacttacgctattttgaaatgaactagcaccacgggtggcttatacctttattaacgtatacagactttgtgatatgaattgtattgctcgaaaggtcaatgtcttgccatgttagtgcgagtgcttctctaagtcttagatctgtaaagaataggactgtaaagagtaatttttatttaccattttcaactaaactctttaattctaaatgtactttattgttctcaagttctaccttattttttcgtctcagtctagtttctagttctcgagtcagactagtacttactttgagaatttagcttttaaatattttccttgtttttttgttttctatgtggtatacttaacaagttaattaaaaggttaaggggatgcctatgaatcgtattgcattagaaattgagaagtacctgcacgagattgttttgagttcggagaatcaattagagattttggttggttcttgtcaaagcacggtgaagttgacgaatacgcaggagcatattttgatgcttattgaaaaggctgcatatactaatactgagattgctaaggagttgaatgttagtcaggctgcgatcacgaaggctacaaagtcattagttgctcaggggttattggtggcggttagagatgataaggatgctcgtattgttcgctttagtttgactgaggctgctaagcctattgctgcagagcatgctcatcatcacgcgcataccttggaagcttatgaagagcttttggaaaattatagtcttgaagagcaggagtcaattgctcgattcttaagtgagttagtggagaagattagaaaatagatgagatatattactgtggaagacttgtcgttttactacgacaaagaaccggttttagaacatattcattattatcttgatagtggggaatttgtgactttgactggtgagaatggcgcagccaagacaaccctcattaaggcgactttggggatattgaagcccaaacaagggaaggtttctattgctgagaagagtataaaggggaagaagttgagaatggcctatttacctcagcaaattgcaagttttaatgctggttttccgagcacggtttacgaatttgtaaaatcagggcgttatcctcgacaaggttggtttcgtcgtttgacagctcatgatgaggaacatgttcggattagtttggaatcagttggaatgtgggaacatcgggataagcgcttaggtgctttgagtggtgggcagaagcagcgtgcggtcattgcgcgtatgtttgcctctgatccagatatttttattctggatgaaccgacaacagggatggatgcagggaccaaggatgctttttaccaactcatgcaccattcggctaagaagcatggaaagtcggttttgatgataactcatgatcctgatgagctgaataagtatgctgatcgaaacattcacttggttcgtgatcagcagtctccttggcgttgtttcaatgttcatgaagcggatgaggaggttgcccatgtttgatctatctgtatttcattatgactttatgcagcgtgctttcctggcaatcattgcgatgagtctgttctcgcccattttgggggtcttcttgatactcaggcggcaaagtttgatgtcggatactcttagtcatgtttcgttggcgggggttgcatttggtttggtattggggatttcaccaacgctttcgactgttcttgtcgttattgtggcagctgtatttttagagtatttgcggacaatttacaagaattttatggaaattgggacggctatcctcatgtcgactggtttggctatttcgctcattgtcatgaataaatctggtgggaaatcagggcttagcctggaacaatatctgtttggttcgattgtgacgattagtcaggagcaggtaattgctttgtttacgattgctgtgattgtcatcgtgctgacattgttgtttttacgtccgatgtatattcttacctttgacgaggatacggcatttgtagatgggttacctgtgcgagcaatgtccattgccttcaatgtggtgactggtgtcgccattgccttaatgattcctgcggcaggtgctttgctggtttcaacaattatggttttgcctgcttctattgcattgcgacttggtaagagctttaaagctgttatctttactgggatgggtattggcttttttggaatggttatggggttgctgacttcttactatgcagaaaccccagcgagtgcaagtattaccttgattttcattagtattttcttactggtgaatgttgttcaaaaatttaaaaaataaggagttaagatgaaaaaagttggtttattattcttgtctgtctcagctttgcttttgggtgcttgtggcaatagcacagcttctgaagatgggaagttgaatattgtaacgaccttttatcctgtttatgagttcaccaagcaggtggcaggtgatgaggcaaatgttgatctgttggttaaggctgggacagaggttcatggttatgagccgtcagccaaagatattgctcgtatccaagaggcagatgcttttgtttatgaaaatgaaaatatggaaacatgggtccatgatgttgaaaaatcacttgatacaacaaaggttaatgtgattagtgcgacggaggggatgttgcttttgcctggtggtgaggaggaacatgaaggtcacgaccatagtgaggaggggcatagccatgcttatgacccgcatgtatggttgtctcctgagcgtgccatcacacttgtagaaaatattcgtgatagtttggtagctaaatacccagaaaagaaagatgcttttgaaacaaatgcggcagcctatattgagaaattagatgctttggatgctaaatattctgaaacattatctgctgcgaaacagaaatactttgttacacagcatactgcatttgcatatttggctttggactatggtttgaaacaagtttctattacaggtgttgctgcagatgaggatccaactccatcacgtctagcagaattgacagagtatattaataaatatggtattaagtatatctattttgaagaaaatgcgtcaaaatctgttgcagaaacacttgccaaagagactggggttcagttggacgttcttaatcctcttgaaagtttgacggatgaggatatgaaaaatggtaaggattatatttctgttatggaagataatctgattgcccttgaaaaaacaacttcccaagaaggttctgaaattttgccagaagaaggtgctgagactgcgcaaactgtttataacggttattttgaagatagtgccgtaaaagatcgtactctttcagattatgcaggtgagtggcaatctgtttatccatacttgcttgatggtacactagatcaggtctgggattacaaggctaagatcaaaggtggtatgacagctgaagagtacaagacttattacgatactggctacaaaacagatgttgatcaaattaacattacagataataccatggaatttgtagtgggagataagaaagaaaaattcacgtataagtatgtgggttataagattttgacctacaaaaaaggaaatcgtggtgttcgtttcttgtttgaagcaactgatgcaaatgctggtaactataagtatgttcaatttagcgaccacaatatcgcccctgttaaaacaggtcacttccatatctattttggtggagagagccaagaaaaactcttggaagagttggaaaactggccgacatactaccctgttggtttgactggtttggaaattggtcaggagatgctggctcactaagaataatgagaagactgggcaaggtgttcagtctttcttcttgacaatttttgactacaaatgtaaactgaagttagaaaattattgttgggaggtgaatgtgtggagcagacaatttctgctgcggagtggcaggtcatgcgggttctgtgggcccatcctggtgcgacttctcaggaaattattcaggccttgcaggaaggctttgattggcaggcgacgactattaagacacttttagggcggctgcggaagaaaaactatttgagaatggctaaggaaactagcaagtaccactattatccgctgattagtgaagaggaacatttgcaggggcaggtggagctcttactagctgccatatgttccacaaaacaggggcaactggttgaaaaactgctagacacagggacattttccaaaaaaagcctagaaaatctggccagcaaaatctcgcagttacaaaggactgcacctgagcaaatcgcttgtcggtgcttggctgggcaatgtacctgcgggcatcatcatactcttcgaaaatcaacctcagacgttgttgacttgacttgatgagtgtaaagctcctgtggagctttacagcctactacctgaaaatgcgaaagtagtagggttctatctgctcttggagaaacgaagacgttcgctttatttccaaccttcaaaggttccccgaacctttgaagctagtctgaatctgattttcattgagtataaaaaaggagaaagaacatgaagcaaactttgaaattgaaaaacttatcgtgccaaaactgtgtcaagcatgtgaccaatcacctcttggacttggatggggtggaagaggtgaaaatccagctggaagagcagttggcggaggtggcaacctctgtggcctatgacttggaacggtaccaagaggtgctggaagatactatctatgaagtggaagagttggtataagcgaaaaagcagccgtcgggctgctttttataatgctttgagaaaatgagtcaggtctagttgcgcttgtgcaagtgaaatttggtcccagaagccgtctgatcgaaagcgtggaattaggtggacatggaaatgggtgccagcattaaacaagcgatcgttgcaggctgtggtcacaccgtcaattgccaatgtttgacagagtttttcagtcaaaaatacttccaagtccgatagttcatagcgaatagtaggtgggacttgactgagtgtgtcatagtggtctttgctgataatcaacagatgcccagtttgaatagggtcaatgtcccagaccaccttgaaatattctgtctggtagagaatatctatttcttcaatctgatggcaaaaaatacaggtcatagctgttctcctattgatagaacaaaaggaaatcatggtggatttccttgaaaaatcttaataagtcaacacagaatacttcttcttcccacgacggataacggttaactcgccgtcaatcttgtcactgtcagaaagggtatagtccaagtcttgcacacgctcaccattgacataaatggcaccattttgtacatcttcacgagcttggcgttttgaattgacaataccagaggtaactagaagttccacgatgttaaggttgtcttcagcctgtacagcgtagtttggaacgttgctgaggccttgtttgagttcttttgcggataggtttttgatattgccagcaaacaattgctcggtgatgttaagggcttggttataggcttcttcaccgtggaccaatgtcacgacttccttggccaaaatcttctgagccaggcgttcatgacgggcagcgtcaaattgtttctcgatttcagcaatctcatctaatgacaagaaagtaaagattttcaagaaacgaacggcatcgtcgtccatgacattgagccagaattggtacatttcatacggagaagtcttgtcggcatccaaccaaacggcgttgccttcagacttaccaaatttcttacctgttgagtcggtgataagtggcacagtcatcacgtgaccagacttgtcagccttgcggcgaagcaattcagtacctgcagtcatattgccccactggtcagaaccaccgatttgtagggtcacattgtgcttgtcattgagctcgtagaagtcatagccctgcatgatttggtaggcaaactcggtgtaggaaatccctgtttcaatccgtttttttacagagtctttgctcatcatgtagttgaccgtgtagtatttaccaacatcacgaaggaagtcgataaagctgatgtctgagaaccagtcgtagttgttgaccatttcagccttgttgtcaccattttcaaaatccaagaagcgagagagctgaccttggatttttgttacccagccgtccacggtgtctttggtttgcaagctgcgctccgcatccttgaaggaagggtcgccaatcagaccagttgcaccgccaactagggcataaggcttgtggcctgctaactgcaagcgacggctagttaagatagcaaccaagtgccccaagtgtaaactatctgctgttggatcgtatcctgtgtaataagaaacctgtccttctgtcaatgcttttaccaaggcttcttcgtctgtcgtttgaaagaccaagccacgagcttttagttcttcaaaaatgttcatgtgggctgtctcctttaggtttaatatacaggaccataaaccattttatatgatttttggaccgaacttcattttaaaaaattcctccctattataccacgaaattgcggaaaataaacaaaatttggtataatggaacgataaggagttaatatggcgactaaatcagataagcaagattttaaaaagaaaatcagtgccctaggcttaggggatgtagtaggagttttccttcggacgctgaaattattattcaattcagtagctgtcttggtgttcctattcggtctttttggtgcgggtataggaattggtttcgtggttagtctttttgatgacgttaagattcccaaaacagaggaactggtagcgaaggtttcagaagttagtcggatttccaccgttacctattcggatggtagcttggtgtcggaagttaattcagatctgcttcgtgtacctattacttcggaagaggtctctaattatctaaaacaggctgtaattgcgacagaggatgaaacatttgaaacccacaatggggttgtgcctaaggctgttttgcgtgcggcactgggatcagttggtctaggttcatctagcggtggttcaaccttgacgcagcaattgataaaacagcaacttgtcggagatgctccaacctttacgcgtaaggctaatgagattgtttcggctttggcattagagcggaatatgaccaaggaagagattttaaccatttacttaaatgtttctccatttggtcgaaataatcagggacgaaatattgcaggggtagaagctgcggctcagggaatttttggtaaaccagcgaaagacttgactgttcctcaggctgcttttattgcaggcttaccgcaaagtccgattgtttattctccctatgcatcagatggaacacgtaaatcagatgaagatatggtttacggtattgaacgctatcaagatgttctctttaatatgtatcgggcgtcattcttgaccaaggaagaatacgaaacctataaagcctacgatattaaacaagattttattgctccagctcctgtaatggcggatacgaaagattatctctattacaaggtcatggaagaagcgcaagaggttatgtttgattacctggtgaaacgtgacaaggtttctaaaaatgacttgaaaaatgatgaaacaaaggcatcctatgaggagttggccaagcaagaattgagccaaggtggctacacgattaagagtaccgttgatcaaaaaatctatgcggcgatgcagtctgttgtggcaaactatggatctgttttggatgatggaaacgaatatgtcgagacaggtagtgtgttaattgataatgccacaggggccattttaggatttgtgggtggtcgcgactatgcaaccaaccaaaataaccatgcctttgatacccttcgttcgccagcgtcaaccatcaagcctctgttagcttacggtattgcgattgatcaaggtttgataggttctgccagcatcctttcagattatccaacgaacttttcaagtggacaaccgattatgtatggttcaggacgtggtactggtatgatgaacttacagacggctattgaccgttctgttaacattcctgctttttggacctataagatgatgagaaatgcaggtgtagatgccaaagcgtacatggataaaatgaattatcatattcctatgtacgatattgaaagtgtaccgttgggtggtggtgttgaaatttcagtattgacaaataccaatgcctatcaaactttggcaaatggtggcgtttataacaaacattacattgttgaaagcattactgcctctgatggaacagtagtgtatcagcatgaagcgactccggttcaagtctattctaaagcaactgcaagtattatgaaccagcttttgagacaggttgtcaactctggttatactacgacgttcaagagtcgattgagtggtttaaacccacaggcagcatcatctgatttcgtcggtaagacgggaacaagtaatgaagtcaatgacgtgtggctcatgctatcaacccctagagtaactttaggtacctgggctgggaatgatgataactcagaaatgtatgtctggacaggctaccacaataattcacaatatgtggcccatatggttgatgcgctttacaatgttaatgcggatatgttcgcaggaaaatttgaattagacagtagtgttattgcttctagcgtcgttgcttctacaggtcaacgtgcagggacaacacaggtaaatgggcgccaagtaacagttggcggtgcgatgacaactagttattgggctaaaaatggtgcaccggtaacgagctataacttcatggttggggggacagatagtgatcgagcacaggcttggaatacaattatcggctcccaaacggcaacatcaagtagctcaacccaacgaagcagttcgactcggagtagcacgagttcttcagctaataacacgaaccagtcatcagaaacgcaaacagcaactagtgagcaagcgaataatgattcaccttgatttttcctagtacttgtgctataatggtataaattatttgtcgtgtgtcttgtttgaaatattgtccaaacaaggcttgcagcagttaaatcaaactttttcaaaggaagatttagctgctctttttgtgtctatgaggaatttttttgagaattgttacctattcttaaagattctaaaaattcagaaaaaggatgaatgttggtcatcacatggctgtatataattgaactcgggctacactcctgtagaactttgactttgtttaccccttggcgtcgtaaacgtctgaaccttcttcgacattctgtctagaaagtcctagtcgttctgacgagggtgcgtcaacgaaatcaaagatttcggacttaccgcttattttcttttggagtgttaaacgccctcgtatctttaattgaactcgacctaaaacctgtgtgaaaaagtgtatgaaatatttactttggtttgtcactcccaacgtcgtaaacgtctggtctttcttcgacattctgtctagaaagccctagtcgttctgacgagggtgcgttaacgaaatcaaagatttcggacttaccgcttattctcactttggttttcacggtctcgtatcttattacaaaggagaaaacttttggcaggacatgaagttcagtacggtaagcaccgtacccgtcgtagtttttcaagaatcaaggaagttcttgatttaccaaatttgattgaaattcaaacggactctttccaagactttttagattacggtttgaaagaagtctttgaagatgtacttccagtttcaaactttacggataccatggaattggaattcgttggttatgaattgaaagagcctaaatacacattggaagaggcgcgtgcgcatgatgcgaactactcagctccaatttatgtaactttccgtctggtgaataaagaaactggcgagatcaagacacaagaagtcttcttcggtgagtttccaatcatgactgaaatgggtaccttcatcatcaacggtgcagagcgtatcatcgtttctcagttggttcgttcaccaggtgtctacttcaatgataaagtagataagaatggtaaagtaggttatggatcaacggttattcctaaccgtggagcttggctggaattggaaacagactcaaaagacattgcctacactcgtattgaccgtacgcgtaagattccgttcacaacgcttgttcgtgcgcttggtttctcaggcgatgatgaaatctttgacatcttcggtgatagcgaattggttcgcaataccatcgaaaaagatattcataaaaacccagcagattctcgtacggatgaagcgcttaaggaaatctatgagcgccttcgtccaggtgaaccaaagacagctgaaagctctcgtagtcttttgacagctcgtttctttgacccacgtcgttacgacttggcacctgttggtcgttataagattaataaaaaactcaaccttcgtactcgtttgctcaaccaaacacttgctgagcatgtgattaacggtgagacaggcgaaattgtcttggaagctggtactgtcttgagccgtgacgtgcttgaaaaagtagaagcacaattcgatgagctcaacttggtagaatacattccaaatgacaatgctgttcttcttgagccagttcttttgcagaaattcaagattgtagctcctaaggatccagaacgtgttgtgacggtgattggtaatgctaatcctgcagaaaacgtacgtacagtaacacctgcggacatcttggctgaaatgagctacttcctcaacttggctgagggtcttggtcgtgtagatgatattgaccacttgggtaaccgtcgtattcgtgccgttggtgaattgcttgctaaccaagtacgtatcggtttgactcgtatggaacgtaacttgcgtgagcgtatgtctgttcaagacaatgaagtattgacgccacaacaaatcatcaatatccgtcctgttacagccgcaatcaaagaattctttggttcatctcagttgtcacagttcatggaccaacacaacccactttctgagttgtctcacaaacgccgtttgtcagccttgggacctggtggtttgactcgtgaccgtgctggttatgaggttcgagacgttcactacactcactatggtcgtatgtgtccgattgaaacgcctgagggaccaaacatcggtttgatcaacaacttgtcttcttatggtcacctcaacaagtatggcttcatccaaacaccataccgcaagattgaccgtgcaactggtacagttacaaatgagatcgtttggttgacagccgatgaagaagatgcttatattgtagcccaatcaacatcgccacttgatgaaaacaaccgtttcgttgataagattgttatgggacgtcaccaaggtaacaaccaagagttcccagcagattcagcagatttcatggacgtttcacctaagcaggtagttgccgttgcgacagcatgtattcctttcttggaaaacgatgactccaaccgtgccctcatgggtgccaacatgcaacgtcaggctgttccattgattgatccaaaagcaccttacgttggtactggtatggaataccaggctgctcacgactcaggtgcggcaattatcgctcaacacgatggtaaggttgtttacgcagatgcggacaaggtagaagtgcgtcgtgaagatggctcgcttgatgtctaccacatttctaaattccgtcgttcaaactcgggtactgcctacaaccaacgtacccttgtaaaattgggcgacatcgtagaaaaaggcgacttcatcgcagatggaccttctatggaaaatggggaaatggctcttggtcaaaaccctatcgttgcctacatgacgtgggaaggttacaacttcgaggatgcggttatcatgtctgaacgccttgtgaaagatgatgtctatacatctgttcacttggaagaatacgaatcagaaacacgtgatactaagttaggccctgaagaaatcactcgcgaaattccaaacgttggtgaagatgcccttcgcaacttggacgaaatggggattatccgtattggtgccgaagttaaagagggcgacattcttgttggtaaagtcacaccaaaaggtgaaaaagatctttctgctgaagagcgtctcttgcacgcaatcttcggtgacaagtcacgtgaagtacgtgatacctctcttcgtgtacctcacggtgccgatggtgtcgttcgtgatgtgaaaatctttactcgtgccaacggtgatgaattgcaatcaggtgttaacatgttggttcgtgtttacatcgctcaaaaacgtaagatcaaggtcggagataagatggccggtcgtcacggtaacaagggtgtcgtttcacgtattgtacctgttgaggatatgccatatcttccagatggaacaccagttgacatcatgttgaacccactcggggtgccatcacgtatgaacatcggtcaggttatggaacttcacttgggtatggcggctcgcaacttgggcatccatatcgcaacaccagttttcgatggtgcaagttcagaagacctctggtcaactgttaaagaagcaggtatggactcagatgccaagaccattctttacgatggacgtacaggtgaaccatttgacaaccgtgtatctgttggtgtcatgtacatgatcaagcttcaccacatggttgatgataaacttcacgcccgctcagtcggaccatactcactcgttacccaacagccgctcggaggtaaggctcagtttggtggtcagcgtttcggtgagatggaggtttgggcccttgaagcctacggtgcttcaaacgtccttcaagaaatcttgacttacaagtcagatgatgtgacaggccgtctgaaagcctatgaagccatcaccaaaggtaaaccaattccaaaaccaggtgttccagaatcattccgcgttcttgtcaaagaattgcaatcacttggtttagatatgcgtgtccttgatgaagacaacaacgaagtagaattgcgtgaccttgatgaaggtgaagatgatgacatcatccacgtagatgatcttgaaaaagcacgtgcaaaagccgcagctgacgcagccgcagcctttgcagcagaagaagcagaaggcaaagaataattagaatggatggaacaagttggtccaaacctcagaactgaaagagataagggccaacggtcttccaccgtctgatttatagaaaaatagcttaccagctatccattctgctgattattgttcaagaatttgaggtatgggaatccatcctctcacaagaaaagaaagggattattagtggttgacgtaaatcgatttaaaagtatgcaaatcacgttagcttcaccaagtaaggttcgttcatggtcttacggtgaggttaaaaaacctgaaacaatcaactatcgtacacttaaaccagaacgtgatggactttttgacgaagtcatcttcggtccaacaaaagactgggagtgttcatgtggtaaatacaagcgtatccgttataaagggattacttgtgaccgctgtggtgtagaagtgactcgtgcaaaagtacgtcgtgaacgtatgggacacattgagttgaaagcaccaatttcacacatttggtatttcaaaggtattccaagtcgtatgggcttgaccttggatatgagcccacgtgcgcttgaggaagttatctacttcgcagcttacgtggtgatcgatccgaaagatacaccgcttgagcacaagtcaatcatgacagagcgcgaataccgtgagcgtttgcgtgaatatggttatggttcattcgttgccaaaatgggtgcagaagcgatccaagacctcttgaaacaagtcgatcttccaaaagaaatcgcagctttgaaagaagaattgaaaacagcttctggtcaaaaacgcattaaagcagttcgccgcttggatgtattggatgctttctataaatctggtaacaagcctgagtggatgattctcaatatccttccagttattccaccagatttgcgtccgatggttcagttggatggtggccgttttgccgcatctgacttgaacgaactctaccgccgtgttatcaaccgtaacaaccgtttggctcgtctcttggaacttaatgctccaggtatcatcgtacaaaacgaaaaacggatgctccaagaagctgtggatgctttgattgacaacggtcgccgtggtcgtccaattacaggaccaggtagccgtccacttaaatcactcagccacatgcttaaaggtaagcaaggacgattccgtcaaaacttgcttggtaagcgtgttgacttctcaggccgttccgttatcgccgttggtccaactcttaaaatgtaccaatgtggtgtaccacgtgaaatggctatcgagctcttcaaaccgtttgtcatgcgcgaaatcgttgcccgtgatattgctggaaacgtaaaagctgcaaaacgtttgattgagcgtggtgatgatcgtatttgggatatcttggaagaagtgatcaaagaacacccagttcttttgaaccgcgcacctacccttcaccgtttgggtatccaggcttttgagccagttctaatcgacggtaaagcccttcgtttgcacccgcttgtctgtgaagcctacaacgccgactttgacggtgaccagatggcgattcacgttccattgtcagaagaagcacaagcagaagcacgtatccttatgcttgcggcagaacacatccttaaccctaaagatggtaaacctgtcgtaacaccatctcaggatatggttttgggtaactactacttgaccatggaagatgctggtcgtgaaggtgaaggtatggtcttcaaggatgcggatgaggctgttatggcttaccgcaatggctatgttcacttgcatactcgtgttggtatcgcaacagatagcctcgataaaccttggaaagacaaccaaaaacacaaggtcatgatgacaactgtcggaaaaatcttgttcaacgcaattatgccagaaggtcttccatacttgcaagagccaaacaatgctaacttgacagaaggaactcctgataaatacttcttggaaccaggatcagatattaaggctgccattgcagaattgccaatcaacccaccattcaagaagaaaaatcttggtaacatcatcgctgaaatcttcaagcgtttccgtacaactgaaacatcagcccttcttgaccgtttgaaagacttgggttattatcactcaacactcgctggtttgacagtgggtattgccgatatcccagttatcgacaacaaggctgaaatcattgaagaatctcacgaacgtgtagaacaaatcaagaaacaattccgtcgtggtatgattactgacgatgagcgctatgcagctgttacagatgaatggcgttcagctaaggaaaaattggaaaaacgcctggttgaaaaacaagatcctaagaacccaatcgttatgatgatggactctggtgcccgtggtaacatctccaacttctcccagttggccggtatgcgtggtctgatgtcagctccgaacggacgtatcatggaattgccaatcttgtctaacttccgtgaaggtctttcagtattggaaatgttcttctcaactcacggtgcccgtaagggtatgacggatacggccttgaagacagccgactcaggttacttgactcgtcgtttggttgacgttgcccaagacgttattatccgtgaagacgactgtggaacagaccgtggtcttgacatccgttcaatcacagatggcaaggaaatgatcgagccacttgaagagcgtttgcaaggtcgttacactaagaaaactgttaaacatcctgaaacgggtgccgttatcattggtccaaaccaattgattacggaagatattgcccgtgaaattgtcaatgcaggtgttgaacaagtaaccatccgtagcgtatttacatgtaacactcgtcacggtgtctgccgtcattgttatggtatcaacttggcgacaggtgatgcggttgaagtgggtgaagcagttggtacaatcgctgcccaatcgatcggtgagcctggtacacagcttacaatgcgtaccttccacacgggtggtgtagcctcaaacagcgatattacgcagggtcttcctcgtgtccaagagatctttgaagcccgtaacccgaaaggggaagcggttatcactgaggttaaaggtgaagttatcgctattgaagaagatgcttctactcgtaccaagaaagtctttgttaaaggtaaaactggcgaaggcgaatatgtggttccatttacagcccgtatgaaggttgaagttggggaccaagtcgcgcgtggagcagcccttaccgaaggttctatccaaccaaaacgcttgcttgaagtccgtgatgtcttggcggttgaaacttaccttctttctgaagttcaaaaagtttaccgtagccagggtgtagaaatcggcgacaagcacatcgaggtaatggttcgtcaaatgcttcgtaaagttcgtgtcatggatccaggtgacacagatcttctcatgggtaccctcatggatatcacagactttacagatgccaatgcggaagtggttattgcgggtggtattccggcaacagctcgtccagttcttatgggtatcacgaaggcttcccttgaaaccaactcattcttgtctgccgcatccttccaagaaacaactcgcgttcttacagatgcagctattcgtggtaaacgtgacaaccttctcggtcttaaagagaacgttatcatcggtaagattatcccagcaggtacaggtatggcccgctaccgtaatcttgaaccacaagccatcaatgaagttgaaatcattgaagacacagtagcagaagagcttgctgcagaagcagagcttgaagctgtaactgaataaattaagatggcacatctctctctttgagggatgtgtttttgatattcggaaagaaaccatatatatgacttgataaggaattaacaagcagaatgttttcttaaatcatacaatttcgatataatgtgtacgaaaaaggaagtaatattatgtatcaagttattaaaatgtatggagattttgaaccctggtggttcttagatggttgggaagaggatgttaccagtagggctgcttttgatcgctatgaggatgcactgaatgcctttcaaaaagagtgggtacggctatcagaggattttccaatgaagaaaagtaagaatggaacgatggtggctttttgggatgaatcagaccagcattggtgcgaggaatgcgatgaatatttgcagcggtatcattcgctgatgttggtagaagcgagagaaaatttaccggctggttttattaagcaacctacgcaacctcgtgtacgcccctgcaaattaaaacaaaataattgcgtaaatgaataataaaagaggattgacctttgcgggtcaatcctttttagctgaatctgatagtaaatgcttccgcatcaagttcaacatgctcgccaatccgaatggtaaacagaggctgggtatgggcaaagtccaaatcatagagaacagggctggttttgagagtagggtgcttgtccaaaatcgccagcaaaatctcctccgtcatcttggtctctttaggaaaacgaccgaagacaagagcctgtggatttggataggcttgtaaaagtgcagtcaagtgacgagcgataatgagataatcgtcgtcttccgcctcctctaaaaatagaatatattcgtctggtctgggagcaaactctgttccagtcagtaggttgagatatttccaccaatggcaataccagaggcctggcctggattgtagactttccattctgttgggtaaaaggtgcgaggggcgtctggtaggtaccaagcgtcgctagaccattctggactcggggtcaagtcaaaggagtcttgtgtcacagccttgagccaggcctgagtctggtaatcttgtccctcacgcatcttaaagctgctatagaatggtcccatgtaagtctgtatacctgttttggcatagatggcattgagcagggcagttgtgtccgaataaccacagaaaatctttggattgcgggcaattatgtcaaaattcaaataaggtaatagctcattgcagttgaaaccaccaatggttgtcaaaatggcatcgaccgactcatccgcaaaggctgcttccaagtccgcaacacgactggcaatcggagccgaatcgaacatatcattttcaaaataatgttctgagaaagagagtttgaagcccagattttctagtttttccttggcggcaagattggcctcaaaaccaccaactctttcgatagaagatgacgggctgacaatgcgaatatggtcgcctttttttaattttttcataggaagctccaagcttttttattattttaacaaaaaagtatggaaaatcaagtctccttacgaattgatagggtgaggaggttgtatgattcaagaaaaagcaagaaagatgattgaagaggcggtggcggatagggtcagtgacatttatctggttcctcgtggtgagtgttaccaagtctatcatcgtatcatggacgatcgggaatttgtgcaagacttggctgaggaggaagtaacagccatcatcagccatttcaagtttttagcaggtttaaatgttggcgaaaaacgccgtagccagcagggttcctgtgactatgattatgggagcggagagatttcacttcgcttatcaactgtcggagattatcgtggcaaggaaagtttggttatccgcctgctctatgacaatgacaaggaactcaagttctggtttgaggcggccgagcggcttgcagaagaaatcaagggacgagggctctaccttttttcgggtccagtcggctctggtaagaccacacttatgtaccatcttgctaggctgaaattcccagacaagcagattttgaccatcgaggatcctgttgaaatcaagcaggaggacatgctgcaactccagctcaatgaagccatcggagccacctacgacaatctgatcaaactgtccctccgtcatcgaccagacttgctcatcatcggtgaaattcgggatgcggaaaccgctcgagcagtcattcgagccagcctgacaggagctaccgttttctcaacagttcatgcaaggtctatttcgggtgtctatgctcgtatgttggaattgggtgtcggtcctgaggagttaaacaatgcccttcaaggtattgcctatcaacgtttaatcgggggaggaggtgtggtagattttgcaaagggaaattaccaaaaccattccgcagaccagtggaatgcgcaaattgatcggctttttgcagcaggacatatcagtcttcggcaggcagaaacagaaaaaattacccttggctcgccagcgtaaggtcattgagcttttcaataatctttttgccagtggttttcatctgggggagattgttgatttcctcaaacgcagtcagcttctggcagatccctatacccaggtcttgtcagacgggttgctggcaggcaaacccttttcgagtttgctggcagatttgcgattttcagatgcggtggtcacacaggtggctctagcagaagttcatggtaataccagcctgagtttgattcatatccagtcctatctggaaaatgtcagcaaggttcgtaaaaagctgattgaggtggcgacctatccgattatattgcttggttttctgcttttgattatgcttggcttgaaaaactatcttctgccccagttggaggaaggcaatgcagcgacagtgctgattaatcatctaccgaccatctttttatctctaagtggacttagtttggtggcggtcttagctggtatggtttggtttcgcaaaaccaataaaattaaggtcttttcctgcttggcagctctgccatttttcggaaaactcatccaaacctacctgacggcctattacgccagggagtgggggagtttgattgggcaaggcttggacctgccgcagattgtgggcttgatgcaagagcagcagtcgcagctttttcgggagattggccaggacctggagcagtcgctttccaatggtcagagttttcacgaacacattaagacctacgccttttttaagcgggagctgagtttgattgtcgagtacggtcaggtcaagtccaagttgggtagcgagttgacagtttatgcggctgaatgttgggaggattttttctctcgggtcaatagagccatgcagctaatccaaccgctggtctttctctttgtggccttaatggtcgttctcatctacgcagccatgttgctgccgatttatcaaaatatggagttgtaaaatgaaaaaattagttgaaatgaaggtaaaagggttcactctggtggaaatgttggtcgttttagggatcattagcctgctcttgctcctctttgtgccaaatttgagccagcagaaggatgctattcagaagaagggggatgcggctgttgtcaaagtagtggagagtcagatggagctctatgaattggaacatgacgaggaagcaacggtggcagatttgcaggcgaaaggttatattactgaaaaacaagcaaaacagtatgctacggcgaaaaaataaggcttttaccctgtttgaaagcctgctgaccttgttggttgtcagttttttagctgtttccttatcaggaacagtacaaacggtctttcggtctgttcaggaagaaatttttctctgggaatttgaggccatctataaagacagtcagaaattagcagccagttcccacaaaaaagtgaaccttgctatcggtggacaggaggttacaaatggttatcaggctgtagaggtgcccagaaacgtagaggtcttagaggagaaaactattcagtttgaagaagatggtggaaattcttctctgaccaagattcgttttcaccttagtcaaaaaatagtcacgtatcaattatatatagggagtggtcgctataagaaaacagaagaataaggcttatattttgctagaaagtctggttgcccttgcgactctagtgaccatttgcagcttgattttatcagctgtggatgcaggtcgtaggcgacaggtttgggaattggaacaacaggaggttttcaacttagcacagatggctgtccagacaaaacaagatgacctagccttaaacggagttgcagttcaggttcaacgaactgcggaaagagttgcggttttccatgaaggaaaggaggttttatcggttgttaaaaagtaaaattcctgcttttacactcttggaatgtttggtggttctagtcattctgtcaggtagcctcttgatttttgaaggcttatccaaattactagtccaggaagcgcattatcaaggtcagaccgttcaaaaggaatggttggtcttctctagccaattgcggtcggagtgggaccaggctgaattggtcaaggttgaaaatggcaaggtctatgtcaacaaaggtgaacaggctttggcctttggcaagtcatggtcggatgattttcggaaaacaaatgatagaggccagggttaccaacccatgctctatcaggtggatagcgcagccatttcccaagaaaaccagctggtgcgcatcgactttagctttaaaaacggagaggagcgaacctttatctatgcttttaaagaaaaaagttaaggctggcatcctactctatgcccttttgatgctggctgtttttagtctcttgcttcagttttatctccaccgccaagaggctgagagtcgcttggtacaggtggcaaggcaagaaacgactgcttatatcatggctcagatggtcttggacaaggtcgagcaggacctgcaagtagaaaaaatagttacgggagcggtagtgaatgaaaaggaagcaaatttaaccacaggttctaagcagaaggagaatagaggaagggtctcctttcaagagggacaggctcgttatcaacttaaaggagaccaactattggttacagttgagttaacaagtgatggtctgtatacctatcaatttccttttgggctatcatcagaaggagggtgagttgactcgttctcctttttagtgcaaagtctgtgaaattttgataagataggagtatgaattttgaaaagatcgaacaggcttacgacctgctattagaaaacgtacagactatccaaaaccagctaggtactaatatctatgatgccatgattgagcaaaatgctacttacgtagctggtcagcatgagacggatcttgttgtcaaaaacaatcagaccttgaaacaactagatttaaccaaggaagaatggcgtcgtgcctatcaattcttgctcatcaaggccaatcagactgagcccatgcagtacaatcaccagttcacaccagactctatcggatttatcctatcttttctagtagaccaattggtgccgactcaaaaggtgacggttctggaaattggttcggggacaggcaatctagctcagaccattctcaacgccagccagaaagaattggattatttggggatcgaagtggacgacctcttgattgatttgtcggcaagtattgcggatgtcatgcaggcagatatttcttttgctcagggagatgcggtacgtccgcagattttgaaggaaagtcaagtaattttgggagatttgcctattggctactatccagatgaccagattgctagccgttatcaggtcgccagtccaaaggaacatacctacgcccatcatttgctcatggaacaatccctcaaatatctggaaaaagatggctttgcgattttgttggctccaaatgatttattgactagtccgcaaagcgatttgctgaaaggttggttacaggagcaagccaatattgttgccatgattgccctgccaccaaatctctttgggaagactgctatggccaagtctatttttgtcttgcaaaagaaagctgcaagatcgttgacgccgtttgtttatcccttacaaagtcttcaagaaccagaagctattcagaagttcatgctcaatttcaaaaattggaagcaagagaatgcaatttaagtgaaaatctgttatactagttaggaaaacgctttaaaagaggtaagatatgtcaaaaacaattgcaattaatgcaggtagttcaagtctaaaatggcaactttatcaaatgccagaagaaacagtactagcagcagggattattgagcgcatcggtttgaacgattccatctcaacagttaagtatgatgggaagaaagaaagtgaagttttagatattcctaatcatacggttgcggttaagattctcctagaagacttgcttaaacacaacatcatcgctgcttacgaggaaattactggtatcggacaccgtgttgttgcaggtggagaatacttcaaggagtcagcggttattagtcaacaagagattgagcaaattgaagagttgagtgccttggcaccacttcataacccagcacacgtggcggcgatgcgcgcatttgaagaagtattgccagaggtgttgaatgtagctgtttttgacactgctttccatacaacaatgccaaaacacgcttatctctatccgattccacaaaaatattatacagactataaagttcgtaagtatggtgctcatggaacgagccactactatgtagcgcatgaggctgcaaaagttttggggcgtccaatcgaagagttaaaattgattacggcacatatcggaaatggtgtatccatcactgctaactatcatggtgaatctgtggatacttcaatgggcttcacaccactagctggtccaatgatgggaactcgttcaggggatattgatcctgctatcattccttatttgattgcgaatgttgaagaactgaaagatgctgcagacgttgttaacatgttgaataaacagtcaggcttattcggtgtatctggcttctcaagtgatatgcgtgatattgaagcaggtatccaagctcacaatccagatgcagtgttggcctacaatattttcattgaccgtattaagaaatttatcggtcagtatcttgcagttttaaatggggcagatgctattgtcttcacggctggtatgggtgaaaatgcaccgcttatgcgcaatgacgtagtagaaggtttgtcttggtttggtattgagttggacctagaaaaaaatgtattcggcaactatggtgacatttcaacggcagaatcaaaagttcgtgtcttggttattccgacggatgaagaattggttattgcgcgtgaagtggaacgcttgaaataagaaaaactaactggtagtcggagactgccagtttctcttatagtttatacctttagaaaggtatagtttttagcaagtggacaaaatatatagtgtgtgatacaatagactagcaaagaaatttgcacagagtagatggtttgcgtcaagtgtatgtggatgggatgttgccacataacgaagctgatctttgcttgcatctgatgtctcctagagtaggaacattggtcctggctgagagtagcgcggtaaaccattgcatccgctgtcgaatacacacgacagctccattttttgaaaaaggagcattttttatggaaaagaaaattccaaaactaacggtgcagttgttggctgctattgcgatgacccttgccttggtcatgattgtagagaactatttctctattcggatttctgatactttacaggttcagtttaccttcattcccaatactattttgggagctattgcgggtccagtttgggcagctgtctttgcggctatttcagacccagtctttgtcttgtttagcgggcaaacggtcctcttcacttggattttgattgaggcggtatcggcatttatctacggctggttcttctatcgaaaaccgctagacaccaagaacaaggctgattggctctatgtggctggtgtagttgtcttgattcaggttgtgatttcctttatcatgacaccgattgccctccatttccattttggaacaccttggattgttctgtatagcagtcgcttgattaaggcagtttttgaaattccattacgcattgtcgtgaccatgcttgtcttgccaagtttacaaaaaatacctgaattggccaagttaatgggcattaaataaaacagtatcaagcaacaggtcatccccctgttgctacttttgtagagagggaatcatgaattatcaagaaactcgccggtggctatctagtcgtcctgcatcagatttagaaaatggcgttgcacgtgtcaactggattttagaacgcttggacaatccccagcttcaagtgccgaccgtacactttgtgggcacaaatggcaagggctcgaccctcaacgccttacagtctatcttgcagtcttcggattacaccgtcggccgctttacatcaccgtctatcattgattttcgagagcagattgtctaccagcaggagatgatttcggaggaagattttgcgaggattgtgacagacttgcaacccttgatcgaggacttggaccagacggctggactggatgccatctcggagtttgagattgtagtagtggctatgtttgtctactttgcccactaccagcgtcccgatattctcttggtggaggccggcatgggtggtttgcaggatgcgaccaatgtccttgcccccttggcagtagtttgtccgtccatcggtttggaccatcaggcatttttgggagagacccacgctgctatagcccgtcacaaggtcgccgtcttgcgtgagggggttccgctcatctatgcgaccgaccagccagaagtggagacagtatttgaggagcatgcctgtcagcttcagagtccgacctatgcggtggggcgggagattcttttggaaaatagcagagcaggctttgcagtttcaagtcctctcggccgtgtggaagagttaacactacagatgcagggtcgtcaccaggaggtcaatgcagccttggcagtgacaacagctcagctcattaaacctcattttccaacaattaccaatgaaaccatccgccagggcttgtcccaagccatctggccgggtcgcttagagttgattaggcctaatctcatgattgacggtgcccacaataatgaaagtatcgccgtcctgacacaactcttggaagaaaagtatgctgacagggatattgaaatcctctttgcggccatcaataccaagccagtggaccagatgttgtcccagcttagccaatttggacctgttagcgtgacgacctttgacgatttcagagcggtacagttagaagattatccgtcaggctatgaacgagttcagacctatcaggagtgggtggagcaggcggacttggacaatcccaaaaaactctacctgattacaggctcgctatatttcattacctatgtgaggaagtacattttagaagaacttgtatagaaaaaaaaggctttgccgggcattcaacccagcaaagtcttttgttttaataatttttaatcaaatcaaccgttgagcggtctagttttttaacgatggtctgcaagaaggcttgggcctctaagaagtcatccatgctgtagagagtttgatgtgaatggatgtagcgagcgcagacaccgatagttgttgatggaacaccatgatttttcaagtgggctgcaccagcatctgttccacctttaccacagtagtattggaatttgacacctgcttcttcggcagttgtgaggaggaagtctttcatgttttttaacatgatgtgacctggatcatagaaacgaagcagagttccgtcaccaatttttccttggtcgccgtaaatatctccagctggcgagcaatcaacagcgagaaaaatgtctggattgaacttggttgtagaggcatgagcaccacgaagaccaacctcttcttgcacattggccccagcaatcaactgatttggtaaagcatgaccggataggctttctagcaattccgtcaccataaggacaccgaagcggttgtcccaagccttagaaataacattttttccgttggctgttagaattgtttcatttttgggaacgaggacatcccccggacgaacgccgaacgcccaagcttcgtcataattggcaaaaccagcatcgaaaataatatcagcaatggcaggcatgccaggagcgttagcccctcgtgaaaggtgaggtggtactgagcctgagatggctggaatggtacgaccgtcctgcaactgaagagtgaaggcttggctagaaacaaccagaggattccagccacctagctcaacaacacggaaagtaccgtcaggcttgatttggctaatcataaagccaacttcatccatgtgggcgaccactaggatacgaggagcattttcaacagccgtatccttgataccaaaaattccacctagcccatctgtttcaatgcggtctacatgtggcgtgattttctggcggatgtggttgcgaacctgtccttcaaatcccggtaagctttgtaattcggtaacttctttaatttttccaaaaagagtcattcttcttcctccatgacatgattactactattttatcacgaagagctagacttgtcttgaaaatatagaaaaatatagaaaaatatagaaaaatatggatagtattgacaagaatgattgaagtttgctaggatagaaatgcccctcaaaatagagaggggagtgattgttaagtgtgggaagcatttatcgtcatttagtttttcttttattacttcgttaattcgccttgcctaacttcagttatgtctgcggctcattgcctcgtactaaaagtaaactaaaagactatatcacagtttttcttgtatctttgttcgtcagttttctaacagttttgtttgaaagatggctcaacaatcgtgacaatagagtgggatttatgacttagagtttgtgtcaacatctcagcgcagtggttgattggtagatttgttcgtgtttcacactccaaatctgaccattacctttgttgcgaacattgttcgctctatctccaacctccaaaggttccccgaacctttggagctatgcgtgggtgagactgaaacggtctgggaatagaccgttttagctcaacaactgaaaacaaggacttgttgacgaactcctttgttctgtctcgctccaaaagaaaaccctcaacgctggtaacgttggggcattttgattgccaagtgttgacaaacatttatcactgtaagaccattctatctatttttaagtcttttgtcaagtggtgcgagtttgtctcaactgtcacaagtccaatggcatttttgggaaaaatcctgggaaatatgataaaatagtcaacatgaaaaagaaaaagacagccttgctagcaggcttattgggggcaggtgtgctcaccgctagtgctcaattttaccgtaaaatccaagaagaccgtaaaaaagcacaggccttgcaggaggtgcgtgactttttcgctgatttaggagagattgccacggtctatgtggatgaaacggcttctacgcagaccactcttatcggaggggttgtgatggaggcaggacaggtatttttgtttgaaaataccaaaggttctattcaatacagggaggaagaaagatgatttttccaacaaatcatgaagaagtagctgccttgattgaagatggcaagccaactgtttttctatttgtgacgacttggtgtggagattgccactatattaaaccgcatgtgccagctatcgaagaagcttttccagatctccgttttgtgcaactggatcgagatgactttatgcctttggcacaggaatgggctattttaggcattccaagtctggttgttttggaaaatggtaaggaaatcggtcgttttgtcgataagaatcgcaagaccaaggaagaaatcatgaacttcttatctggactgggtagataaattagcagagaagctctgccatttcccaaaagaaaggaaagaacatgaagaaatcattaggaaaaatccttctagcacctgtggtgctggggttgagtttgagtcttgctcccttggtgcaggctgagattcaaacagatgttatcaatgaaaaatggggcaagccaacactagtctacggtggaggtttgtcagatgcgcaggcgacagaggttaacaatctatttggtatttcggatgtcaataatgtcagtcgtcaggtggttgttggtacggatatggaccaatatttaggtacatctgaagcggacacagcctccctctattcatctgtcttggtgcaaaagcaggacgctggcaaaggggttgtggtggatattaagacgccacagaacatcaccttgattaccgaaacgcagtatgccaatgcggctattacagctggtgcgacagatgtcttgattgatgtagcttctccgattcaggtaacgggggagtctgctttgacaggtgtttacaaggctctcgcagccaatggtgaaacagttgatacagcccgaactgaagtagcccaacaagagctagagacagtcaatgaagtggcgacggctcatacaggtgacactaattttgatagttcggccttggataaggcagtggcggaaatcaagactgctcttgccgactacaaaaagtccaatggtcaggtggcttctgaggctgacatcaacaccatcatcaatgatgttttggcccaaaacggtttggaaaatgtcatcacagcagatgaagtttcaaaattagttacctttgccaaagcttatcaggaaacctctgctattgattcggctgaggttgctgcccagctcaaccagttcaagcaacaggcggagcaacaaatttcagaagcctataagaatctacaagattcagggattttagaaaaaatcggtgccttctttgaaaatctttggaaaggcttgaccggtctatttgcataaaggagaaatgaaaaagaaatgatttttacatataataaggaacatgtcggcgatgttcttatggtgattgttgcggaggacaagggacaggctgtccagtttgaacgcaagggtcaagtggcgcgtgttttcctagaagaaacaggaaaaacagtggcctggaatatttttgaagcatcaagtttggttgaacttgatggaaatggtcaagttttcttgacagatgaacaagttgcgaccttgaatgctgaattggctaaggaaggttttactgaaagcttggttaacgacaatgctccaaagtttgtagtcggtcagattgtggaattggttcctcatccagacagcgaccacctcaatatctgtcaggtcaatgttggtgacaaaacagtgcaaatcgtagctggtgccccaaatgctgcccaaggattgaaaactattgtggctcttccgggggcaatgatgccgagcggtagcctgattttcccaggaaaattgcgcggtgaagatagctttggtatgatgtgtagtccgcgtgaattggcactgccaaacgcaccacaagtccgtggtattatcgaattagacgactccgcagtggtcggagaggcctttgatccagctaaacactggaaggggtagaaaaagaagaattggtcaggtggccaattcttttatgctggttcaatttttccttcaatagcctgttcgatttcttcggtcgaggcctgttgtgatttgagttggaaataaagactggacaggaaatgctggagattgagccaccggaagtagtctactggttcttgatttggaaagtccagcttgctaatccattccgtcagctcttggcttgacactttttcattcagcaggaggtagacagggatttgtgccagacggatttcctcgccagctgagaaaactttactttgtttagttagacaagtgacaatagtttgccagacttctttgcttttttcagcgggaaattgatcatgacagcttgtggccagaagaaaatctgctccgtgggcagcggtatggatccaaccgagtttttcatcgtagccagaccagtcattttcaatcgtcaaataatccaaggcctgctggaagagtagctcatggtcgtcagtgcttaaaaatgcatgataaatagactctggctcattatcgacagacagcaacagacagtaaagtaggcaagtaaaacttcgtttttgtgtggggccttctagggaaaatggcttggtttcttgagagaattgcagtagcgactgtgcttgttctcttgtaatcaagccctccaaaaagatatggcaaaaactagcatagaccagttcgtcgcgtatagtagggtctggatggccgatgttttccaacaaccaatccagttcggcattggtatatggttgggaggtctgtatcttttccatcaaaaattctttcatgattttcgctccttttctaatccttctacgaatagataagtaggaggatataatatgtataataaaacaattttaatcggtcgcttgacggcccaacctgaactcactcaaacaccaactggcaaaaatttgactcgtgtaactgtcgcagtcaatcgccgatttaagacagaaaatggtgagcgtgaagcagattttctcaatgttattttctggggcaaactggcggagacacttgtttcttatggcagcaagggtagtctgatttctattgatggtgagttgcgaacgcgaaaatacgaaaaagacggcagcaaccactatgtgacagagattctaggccaatctttccaattactagaaagccgtgctcaacgtgccatgcgtgaaaataatactggtgatgacctagctgacttggtcttggaagaggaggaattaccgttttaaagcaatatcagtcccaagaccgatggagtgtattgaaaaataggctatactatagtcaatcctaaatatttttcatatctccttaaaaacaccgacgaaagttggtgtttttggctacttattttctatatttccaccattctatcagcatgataattagagaaagtaggagaactccgtagaagaaaaagatgatgtaatgagggtgggaaaagagaagccaccagactagccagagtaggtaggcgaatatcattttccccaaaaagcctaatttacgttttaaaaaccattctgcaaaactttcgtaggctgaaaatcggctttcaaggtaatcaatttttaaatctctaaaaaatttcatgaataccccctaactttttaaaaatagtatagcataatttagcggtaatggataggcaagttctgtctcggtctcaagatggattttcatgaaaaagggatagaatgttcttgactatttttgaccaagtgatacaataggaaatgtgaattagcactcgaatacaaagagtgctaaaaagaccaggaggtaataccatgttgaaaccattgggcgatcgtatcgccgtaaaaattgaagaaaaagaacaaacagttggtggctttgtcctagcaggcgcaagccaagaaaagacaaaagaagcaagtgtcctagcgatcggacaagggattcggaccttgaacggagacttggttgccccagcggtggcagttggagatactgttttgattgatgctcacgcaggattggaagtcaaagacggtgatcagaacgttcacatcatccgtgaaacagatattttggcaattgtagaatagaggtagaaaaatggcaaaagaaatcaaatttgcagcagatgcgcgtgaaagcatggtccgtggtgtcgatattttggctgacacagtcaaagtaaccttgggtccaaaaggtcgtaatgttgtcttggaaaaagcttacggttcaccactcattacaaacgacggtgtaaccattgctaaagaaatcgagttggaagatcattttgaaaatatgggtgctaagttggtatccgaagtggcttcaaaaaccaatgacattgccggtgacgggacaacaactgctactgtcttgacccaagctatcgtacgtgaaggcttgaaaaacgtaactgcaggtgccaacccaatcggaattcgtcgcgggattgaagccgcggttgcgactgcggttgaagccttgaaagcacaagcaagtcctgtatccaataaagctgaaattgctcaggtagcagccgtgtcttcacgttctgaaaaagttggtgagtacatttcagaagctatggagcgcgtgggaacagacggcgttattactatcgaagaatctcgcggtatggaaacagaattggatgtggttgaaggtatgcaattcgaccgtggttatctgtcacaatacatggtaacagataatgaaaagatggtagctgaacttgaaaatccatttatcttgattacagataagaagatttctcatatccaagatattttgccactcttggaaagcattcttcaggccaaccgtccgcttttgattattgctgacgatgtggatggcgaagctcttcctacacttgttctcaacaagattcgtggtacattcaacgttgttgcagtcaaagctccaggctttggtgaccgtcgtaaagccatgttggaagatatcgctatcttgacaggtggtacagtcattacagaagaccttggtttggacttgaaagatgcgaccattgaagcccttggtcaagctgccaaggttgtggtcgacaaagatggtgcaaccattgttgaaggtgctggcaatcctgaagccattgccaaccgtgtggctgttatcaagtcacaaattgaggtaaccacttcagaatttgaccgtgaaaaattgcaagagcgcttggctaaattgtcaggtggtgtcgcagttatcaaagtcggtgccgcgacggaaactgagttgaaagaaatgaaactccgtatcgaagatgccctcaacgcaacacgtgccgcagttgaagaaggaatcgttgccggtggtggtacagcacttgtaaatgttatcgatagcgtagcgaaattggagttgaaaggcgacgatgaaacaggacgcaatattgtccttcgtgccttggaagaaccagttcgtcagattgcctataacgcaggctatgaaggttcagttatcattgataaattgaagaattctgagcttggcactggctttaacgctgcgacaggcgaatgggtcaatatgatggatgcaggtattattgaccctgttaaggtgactcgttcggcccttcaaaacgcagcttctgtagccagcttgattttgacgacagaagcagttgttgccaacaagccagaaccagctgctccagctatgccacaaggtatggatggaatgggtatgggctactaagaaatagcaaaatgacacagctacttggctgtgtttttttcttgaaaatttcaaacatatctatttgacaatggttttgggatgtggtactatattagacggtactttttacttttggtctctcaagagtgtacagggacgtgctgacaaatgttgcaaaagtacacacagataggggttgtcaccaatgccctatcaccaaaaataaaaaatatatacaggagaatgtagatgcctacaattaaccagttggtacgtaaaccacgtaagtctaaagtagaaaaatctaaatcaccagctttgaacgttggttacaacagccgtaaaaaagttcaaacaaacgtttcatcaccacaaaaacgcggtgttgcaactcgtgtcggaacaatgacacctaaaaaacctaactcagcccttcgtaaatttgctcgtgtacgtttgagcaaccttatcgaagttactgcttacatcccaggtatcggtcacaacttgcaagaacacagtgtggttcttcttcgtggtggacgtgtaaaagaccttccaggggtacgttaccatatcgttcgtggtgcacttgatactgctggtgtaaacgatcgtaagcaaggccgttctaaatacggtactaaacgtccaaaaggctaagaagggggaaatataaatgagtcgtaaaaatcaagcgcctaagcgcgaagtattgccagatccattgtataactcaaaattggtaactcgcttgattaaccgtgttatgttggacggtaaacgtggtactgctgcatcaatcgtttacggtgcctttgatcaaatcaaagaagcaactggtaacgatgcacttgaagtatttgaaacagcaatggaaaacatcatgcctgtacttgaagtacgtgcacgtcgtgtcggtggttctaactaccaagtcccagttgaagttcgtccagagcgtcgtacaacacttggtcttcgttggttggtaacaatcgctcgtaaccgtggtgagcacactatgatcgatcgccttgcgaaagaaatcatggatgcagcaaacaacacaggtgcagctgttaagaaacgtgaagatactcacaaaatggcagaagcaaaccgcgcattcgcacacttccgctggtaagataggatattttagcgttaaacaaatgctagccaaaataggaaaattgacgcagaaacttcagtttctaggagattttatctttttggcagacatttgtagctaaaattcaactaagattaagatacgagggcgtcaagcaactcctagacaaaatagggaagcgaagcagattgctgtgcaatcaatgaggttcatctttttgtcagcgagttgtagcccgagttcaattaggatgtaaggacgttaagaaaattcaaggaaaaataggaaatcagacgatggaccttaaggtccaaggaagatttatcttttttccagaatttttagttcgaactcaactaattaagatgtgaggacgttaaatcagttctacataaatcaattgagattatggtagcaacttatcgttcaaccatcacaaatcggattgaggcttgcctcgtccacttcacaccattagtaagaacttaagcgggtgggatttgcccactcgcttttcttaaaatatggtataatcagaatagaaatctaaaaatataggagaacaaacctcatggcacgcgaattttcattagaaaaaactcgtaatatcggtatcatggcgcacgttgacgcgggtaaaacaacgacaactgagcgtattctttactacactggtaaaatccacaaaatcggtgaaactcacgaaggtgcatcgcaaatggactggatggagcaagagcaagagcgtggtatcactatcacatctgctgcgacaacagctcaatggaacaaccaccgtgtaaacatcatcgacacaccaggacacgtggacttcacaatcgaagtgcaacgttcacttcgcgttcttgatggtgcggtaaccgttcttgactcacagtcaggtgttgagccacaaactgaaacagtatggcgtcaagcaactgaatacggtgttccacgtatcgtattcgctaacaaaatggataaaatcggtgctgacttcctttactcagtaagcacactccatgagcgtcttcaagcaaatgctcatccaatccaattgccaatcggttctgaagatgagttccgtggtatcatcgacttgatcaagatgaaagctgaaatctatactaacgaccttggtacagatattcttgaagaagatattccagctgaataccttgagcaagctgaagaataccgtgaaaaattggttgaagcagttgctgaaactgatgaagaattgatgatgaaataccttgaaggtgaagaaatcacaaatgacgaattgaaagctgctatccgtaaagcaactatcaacgttgaattcttcccagtattgtgtggttcagccttcaaaaacaaaggtgttcagttgatgcttgatgcggttatcgactaccttccaagcccacttgacatccctgctattaaaggtgttaacccagatacagatgctgaagaagagcgtcatgcatcagatgaggagccatttgcagctcttgccttcaagatcatgactgacccattcgtaggtcgtttgacattcttccgtgtatactcaggtgtccttaacagcggttcatacgtattgaacacttctaaaggtaaacgtgagcgtattggacgtatccttcaaatgcacgcaaacagccgtcaagaaattgaaactgtttatgcaggtgacatcgccgctgcggttggtttgaaagatactacaactggtgactcattgacagatgaaaaagcaaaaatcatccttgagtcaatccacgttccagaaccagttatccaattgatggttgagcctaaatctaaagctgaccaagacaagatgggtattgccctttctaaattggctgaagaagatccaacattccgcgttgaaacaaacgttgaaactggtgaaacagttatctctggtatgggtgagttgcacttggatgtccttgttgaccgtatgcgtcgtgaattcaaggttgaagcaaacgtaggtgctcctcaagtatcataccgtgaaacattccgcgcttctacacaagctcgtggtttcttcaaacgccagtctggtggtaaaggtcaattcggtgacgtttggatcgaattcacaccaaacgaagaaggtaaaggtttcgagttcgagaacgctatcgtcggtggtgtggttccacgtgaattcatcccagcggttgaaaaaggtctcgtagaatctatggctaacggtgttcttgctggttacccaattgttgacgttaaagctaagctttacgatggttcataccacgatgtcgactcatctgaaacagccttcaaagtggctgcatctcttgcccttaaagaagcggctaaatcagctcaaccaactatccttgagccaatgatgcttgtaacaatcactgcacctgaagataacctaggtgacgttatgggtcacgttactgcacgtcgtggtcgcgttgatggtatggaagctcgtggtaacacacagattgttcgtgcttatgtaccacttgctgaaatgtttggttacgcaactgttcttcgttcagcaacacaaggtcgcggtactttcatgatggtatttgaccactacgaagatgtaccaaaatctgtacaagatgaaatcattaagaaaaacggtggcaatgcataattgtctatctacacctaccttcgggtaggtgtttttttggtacgacggatatgtcacacatctgagcgtgatactcatactcttcgaaaatcaaaattatccgttgtcaacttgccttgatgaactccagttctatcttcggcttcgtttcctaggctacttttgattttcattgagtatcagtagtttatctttgattgcttcgacgagcgaggaaacttcgtttccttatttccaacttcaaacacttcactggagtatttgaactcgctttgtcgtactttacagaagtgatttgcgaggcaagtcttatttccaacctagaacagcctttaggctgttctagcaacttgcagctattgagacgaacttgcttcgccctatctccagccttcaaaggtttcccgaacctttgaagcgagtactaaaaacaaactaaacgactacactatataaaacagatatccgccagattcattttggaaatatacaatgagaaagctacaatttataaaaaattaccctaatttaggtgtggatggctaacaaaagatcagggtttgctattttgggatttcattgggtataagttcctgttgtcgatgaactcaacagtgactcccaggtccgactactgtgaaataaacggattaaaacagtctggggttagactatttcagctcaacaactagaaattaggaattgttgccgaactcttttgatcgttcgagttctcgcctactcacacttaatcagctaaaataaatgttttaaattatttagaattactttgtttgggaatggttataaaaaataagagaattaatagataggctacagaagaaaagcagatataaatgttagaatccttataaggtagatcgatgaaagagtagtttaggaccgctaattactaaaggaggatgcttgtatggtgatgaaatagtggtactaagcacattaacaataaaaagaaaggacagaaaccatgagaaaaaaactaaaattttcattagtagcagtcgcctgtgcgacatttttgacagcctgtggcacaagtaattcctcggctcccaaagcaggtgaagcaacaccacagacggattttcattcttatatcaatgcgcaatggttgaaaaatacaaaattaggtgccggtgaatcgcaaatagataatctgagtcaactctctgagaaaacgcaagaagcgatacaggagatgattgaccagctggatatggactattccaagctgcaagctggtagtgatgagaaaaaacttattgatttttaccgattggcagccgattttgatactcgcaacaaattggggttagagcctattaagccttatctagaggagattaaaaaagcctctaccatggaagaactcaacaagattctggtggccctatacggcaaaaacatccgcaatttgcttcatataaacgttactcaagatataaaagacagtaacaaaaacaccatctacgttgaccctcacgagttaagttttccaaaagaaaattatgatggcacagatgaattttcattgaaaaatcaaaaagcctttaaagcctatctgcaggaagtatttagcttgtcaggagaaacctcaaaagaagcctcttctaaggcagatctcctctttaatttggaaaaagagatggctgcagtgcaacggccaaaagaagaagccaataactttgaagccatgtataacgagaagacttgggatgaggtcaaagcactggttcccaacctaccgattgctgagttggtttctgagttaggacttcagaatgccccaacgacagtcgtatcagatccagatgctctaaaaaatttaaatgaactctatcaagaaaagaatttagacgctcttaaggctctgctccaatatcgtgtgattgcccattacaatgcttatctgtcaagcaatttaatcgaggcaaaagcgaaatacgacggcgtagcaaccggtgcggtagatactccgagtcagaaagaagttgctcaagcggccattgatgcaaatttctccgatatgattggcaaagtttacgttaaacaccatttttcagaagaatccaaggctaatatcctatctatggttcaagagattaaagcgacttatgcagagcgaatcaaagcagtgcagtggatgtctgaagaaaccaagatgcgggccttgaaaaaactagatacattggttgttaaaatcggctatccagaccagtggaaggattactcacaacttgctatccaatccaaggaagaaggggggagtcttctttctaacttcgatatggtaaaaacacttgaattgcgtgaagagatggggcaatttggcaagccttttgataagtcgcagttcggcatgccttctcacacggtgaatgcctattacagcccaactaacaacgaaattgtctttccagcggggattttacaggctcctctctacgatccaaaagctagtcccgaagaaaatctaggtggaatcggggctgttatcggtcatgaaatttcccatgcctttgataaggctggttctcaatttgatgaaaaggggaaccttgtcaactggtggaaaccagaagaccttgaaaaatttaataaaaaggttcaacaggcagcagatatctactctaaattggaagtggctccgggctactatgtcaatggcgaaatttcaaccggtgaaatcatggcggatctcggtggtttaacggttgccattgatattgctcagaaaaaaggctacgatacgaagaaagtcttcgagtcttatggtaaagcatggcgtgaagtcaccaccaaagaatttgctattgccaacatcagcgacgaacatccaccagctaaatatcgggttaacaacattgtcaaccaaattgatcaattctatacagacttcaatgtcaaagaaggggatccaatgtatgtgaaaccagaagaccgcctacgagtgtggtaaaagattatagaggtgtctgcggtccaaaatgggcggtagacacctttttaggtaaaaaatagaagtagcggtaaaccaagaatcggtaaaaaatgtgtcgaggtatggcaatgctattaagttaagtatttaaccagtcataaccacccgagaaaacgcatggctatgatttttaacttttattttttggccttctattttttacataagatgaaccggtaagcagttgcaattttcggtaaatagttatataataaaaacgttgaaaagatgcttgtaggcttacaagttaatattttcacaaaaggattaaaaggcttgccttttaaaataaagaactcgattttcataaggaggaaatcattcatggtagttaaagttggtattaacggtttcggacgtatcggtcgtcttgctttccgtcgtatccaaaacgtagaaggtgttgaagttactcgtatcaacgaccttacagatccagtaatgcttgcacacttgttgaaatatgacacaactcaaggtcgtttcgacggtactgttgaagttaaagacggtggtttcgaagttaacggtaaattcgttaaagtttctgcagagcgcgagccaggaaacatcgactgggctactgatggcgtagatatcgttttggaagctacaggtttctttgcttctaaagaaaaagctgagcaacacatccacgctaacggtgctaaaaaagttgttgtcactgctcctggtggtaacgatgttaagactgttgttttcaacactaaccacgacatccttgatggtactgaaacagttatctcaggtgcttcatgtactacaaactgtttggcaccaatggctaaagctcttcacgatgcatttggcgttcaaaaaggtttgatgactacaatccacggttacactggtgaccaaatggttcttgacggaccacaccgtggtggtgaccttcgtcgtgcacgtgctgctgctgcaaacatcgttcctaactcaactggtgctgctaaagctatcggcttggtaatcccagaattgaacggtaaacttgacggtgctgcacaacgtgttccagttccaacaggttctgtaactgaattggttgcaactcttgacaagaaagtaactgctgaagaagtaaacgctgctatgaaagctgctgctactgaatcatttggttacactgaagaccaactcgtatcttcagatatcgtaggtatctcattcggttcattgtttgatgcaactcaaactaaagttatcgaagttgatggcgagcaattggttaaagttgtttcatggtacgacaacgaaatgtcttacactgcacaacttgttcgtactcttgagtacttcgcaaaaatcgctaaataatccttagtgaaaatcgaagaggcttcggcctcttttttgttttgattgctgaaatatagctgtttccttatgctaagaaacaaggatggtataagttgtttctgatttggcaactttagaatttgaaaaatctgattacgaggcgatagtttttagatttcataacatttgtgaaaaaaatatctttatgcaagaaaaaatacagaaaatatgatacaatggtaaagtaaatataatttaaggagttcttatctaatggcaaaattgactgttaaagatgtagaattgaaaggcaaaaaagttcttgttcgtgtggacttcaacgtgcctttgaaagatggcgttatcactaacgataaccgtattacagcagctcttccaactatcaagtatattcttgagcaaggtggacgtgcaattcttttctctcaccttggtcgtgtgaaagaagaagctgacaaagaaggtaaatcattggctcctgtagcagctgacttggcggctaaattgggtcaagacgttgctttcatcgcaggtgctactcgtggtgctgaattggaagcagctatcaatgctttggaagatggacaagttctccttgttgaaaacactcgtttcgaagatgttgatggtaagaaagaatctaaaaacgacgaagaacttggtaaatactgggcttcacttggtgatggtatcttcgttaacgatgcatttggtactgcacaccgttcacacgcatcaaacgttggtatctcagcaaacgtagaaaaagcagtagctggtttccttttggaaaacgaaattgcttacatccaagaagctgttgaaactccagagcgcccattcgtggcaatccttggcggttcaaaagtatctgataagatcggtgttatcgagaaccttcttgaaaaagctgacaaagttcttatcggtggtggtatgacttacacattctacaaagctcaaggtatcgaaatcggtaactcacttgtagaagaagacaagcttgatgtggcaaaaacacttcttgaaaaagcaaatggtaaattaatcttgccagttgactcaaaagaagcaaacgcatttgctggatacactgaagttcgcgatacagacggcgaagcagtttcagaaggcttccttggtcttgacatcggtcctaagtcaatcgctaagtttgacgaagctttgactggtgcgaaaacagttgtttggaacggacctatgggtgtatttgaaaacccagacttccaagctggtacaatcggtgtaatggacgctatcgtgaaacaaccaggcgtgaaatcaattatcggtggtggtgactcagcggcagctgcgatcaaccttggccgtgcagacaagttctcatggatctcaactggtggtggtgcatcaatggaactcctcgaaggtaaagtgcttccaggacttgcagctttgactgaaaaataggcggtaagtcaggaatctatgattccgtagacgcacccccgcaaggctgaataggttggtcacaagcgtagcaaagtgaactgccattcagctactgcgtatgaaagatgaacgatgaaaagagttgggagaccaactcttttctagtacaaaggctagattttctgtgaacgtagtgagtttagaaaatcagcctaggtaaaggctaaaatgcaacggatttccgttgcattttgtgcatcgcgtagagtttctacgaagctaagcgagttagaaagtctagcaaggtgtaaagtgcttccaggacttgcgacggcacggagtgcctagtgccatgcctagtctttctgggaagtgtgacctagaaagactggctaggtgctgccttgactgagaaataggcggtgagtcagttcaacatatctcccagatatgttgaggttagaaatagaagaaacgaagcttctgtcaaaaatgattccgtagattgttactttgatttttcttggtgacaacttcaaatagtccactgggctatttgaaccccgcaaggctgaatcttggtcacaactcccattcagctactgcgctaaaaatataaatgtaaaaaaagacgttgttttttgcagcgtctatttgtttgtcttacttctgggttccttcttgcagctgatttaaagtggcagattattggtttttcgaaaagctggcgtgaacaggaggcttttccagtcgagcttaggagaaaagaaaagctgggcaggtatttgctattctattttccgaaatcatgttagaatagaggcatgtttaaaaaatatacatttgatccaaagaaatttcggttggggatgcggacgttcaaatcgggtttggcagttttcctagttattcttttgtttggttttatgggctggcaagggattcagattgcggctttgacggctgtgtttagtttacgagaagacttcgatcagagtgtccattttggagcttctcggattctgggcaattctattggtggtttttatgcgctacttttctttattttggataggttattcttagatcatttttgggtaactgcggtttttgttccgatatttgtcatgttaacgattatgacaaatgtggcgatgaataataaagcgggaattattggtggagtatcagctttattaattattacattgtctattcctgctggtgatacgattcaatatgtgtttattcgtgtgtttgaaacctttatcggagttttcattgcgattctagttaattatgatgtgaatgttataaaaaaacgttttcaggataaatgatgttataaaatataacatcacctattgacctcaaaaaaaaattctcctataatggtaggcagaaaggagttcattatgagagaaaaagagtttcgtcgttccttagctatctttccgatcggtagtgtgatgaagttgacagatttaactgctcgtcaaattcgttactatgaagatcaaggcttgattaagcccgatcgcaacgaagggaatcgtcgcttgtattctctaaacgatatggacttacttttagaaatcaaggattttttggatgaaggtttgaatattgctgcgattaagaaggaatatgcaaatcgggaagcgaaagctaaggtccaaaaacagcagaaaaccttgactgatgaagatgtccgtcgtatcttacatgatgaattcagtcgtcagggacgattttcaagtcctagttccattttccgttcgtcgtaattagcttttaaaatagaggagaaaaataatgacattcacagtggcagatatcaagcgcgatatcaaagagaaaaacgttaccttcctacgtcttatgtttacagacatcatgggagtgatgaaaaacgtagaaattccagcaactgatgagcaggtcgaaaaggttttgtcaaataaggtcatgtttgatggttcatctattgaaggatttgttcgtatcaatgaatcagatatgtatctttacccagatttggatacatggactatcttcccttggggtgatgaaaatggccgtgtagctggcttgatttgtgatatttatacaacagatgctaagccttttgctggtgacccacgtggaaatttgaagaaatcgcttcgtcacatggaagaggcaggtttctcttcattcaaccttggtccagaaccagaattcttcctctttaagatggacgaacaaggaaatccaacgcttgaagtaaatgataaaggtggttactttgacctcgcaccaacggacttggctgataatacacgtcgcgaaatcgtcaatgtcttgacagagatgggctttgaagttgaagcgagtcatcacgaagtggcagtaggtcagcatgaaattgacttcaaatatgcggatgtcttaaaagcttgtgacaatattcaaatcttcaagttagttgttaaaacaattgctcgtaagcatggcatgtatgcgacctttatggccaagcctaagtttggtattgctggctcaggtatgcactgtaacatgtccctctttgacaaggatggaaacaatgccttctttgatccagaagatcctcgcggtatgcaactgtctcaaactgcttaccatttccttggtggtttgattaagcatgcttataactatactgctattacaaacccgacagtgaactcttacaagcgtttggttccaggctttgaagctcctgtgtatattgcttgggctggtaaaaaccgctcaccattggttcgcgtacctgcatcacgtggaatgggaactcgtttggaattgcgctcggttgatccaactgccaacccatacttagctatggcagttctattggaagttggcttggaaggtattcaaaataaaattgaagcaccagcaccagtagaatctaatatctatgcaatgtctgatgaggagcgtcgtgaagcaggtatcactgatcttccttcaactcttcacaatgcattgaaagctcttcgtgaagacgaggtagttcgtgcagctctaggtgatcatatctatacgaatttcttggaagctaagaaaatcgaatgggcaagctacgcaacctacgtttctcaatgggaaatcgacaactatttggatatgtattaaacaaaggaccccgacgggtcctttgttcacgagccgagaaattggaaatcgggtaatggtccagtggagtgaagtggtctggaaagagactgtttcagtctgagctaataaatagcagggcgaggggatagacatgagcttgaaatctgtcttttttcaagctgggttatcttgttaatataaaataaatcccagaggtttcacctctgggattttagtgtgttatcggtcaggcgtcagaatcattgggataatgattggttcacgctctgttttttcgtataggaatggtcgtagggcgttaacaatggcgccgttgactgtttggatatttgcgtctttgttgcgcatggcgatgcggatagcgttgaaaaggacgcgttggctttcgcgaatgagctcgccagattctctcatatagataaagccacggctgaggatgtctggtcctgctaatatcatcttagaattaaaatcgacagtggctactgcaaggacaacaccatcttctgaaagatcgcggcggtcttttagaacagctgcgccgatttcaccgatgcggtttccatcaacatagatgtcttgggcgttgaattgacctgcgagacgtgcagaatcttttgtcagagcaaggacatctccgttttccatgatgaagatattatctttgggaacgcctgtatcaacagctaggctggcatggattttttgcatgcggtattcaccatggacaggcatgaagtatttgggtttgatcaagcggagcatgagtttttgctcttgttgaccaccgtgtccagaggtatggatgttgttgatcttgccgtgaataacatcgacaccggcttcaatcaagatattgatgagcttgttgacacctgtggtatttcccggaataggactggacgagaagataaccgtgtcgcctggctggagttgcacctgacggtgggtaccgtgggcgatgcgagagagtgcggccataggctcaccctggctacctgtacagagaatcatgatctcgctggcagggtattctttgatctcgtttggctcgatgaaggtatccttaggcaccttgatgtagccgagctcgataccgttaacaatggctttttccatggaacgtccaaagacagcgatcttgcgtccggtcttaaccgctgcatcagccgcctgttggagacggaagatgttggaggcaaaggaagcaaagatgatgcgtccgtgaatgccttcaatcagcttcataatggactgaccgaccactttttccgagttggtgaaggttgggacttcagcatttgtcgagtcggaaaggaggcagagaacgccttcttcacccagggcggccatgcggtgaaggtctgctggctcaccaacaggagtgaagtcgaacttgaagtcaccggtacagacgattttcccttgaggtgtatcaacgacgataccgagaggttctggaatggagtgggtggtacggaagaagctgactttgaggtgcttgaaggtcaactctgtattatgattgatttcatgcaaagtcgcatcacggagcagaccgtgttcttccaatttgcctcgaataagggcgagggctaaaggtccagcatagattgggacattggcctgcttgagtaagaagggaatgcctccgatgtggtcttcgtgcccgtgggtaataaccagacctttaacgcggtctaggttttcaacgatgtaggagtagtctgggataacgtagtcgatacccaataggtcatcttctgggaacttgataccggcatcgacgatgagaatttcatccttatactcgataccgtaggtgtttttcccgatttctcccaaaccaccgatggcgaaaacgccaacttcatgaggttttagattgactgatgacatggattaaaactccgtaattttgaaatctgcgtgctctttctcgtattcaagatgattgtctgataagaggtcgataaattcgatattgtattcagggcggttggtttccaccaattcacgcgcgataatacgaccttccaattctgatgcagcatcgatgtctagataaagagcacgtgtctgctcgcgacgtgggctaatttttgattcttgatagaatactttataaatcatgtgtagtatagttcctttctttttgactggcaactatgaaaaaagcctcaaacagttgggtctgtctggtaatatctattcaattttctcgagttgtcaatttattcagtctaaatgtactcttcattataccataaaatatgctgatggtaaaagggtttggtaggaaaatggaaaagtgtcatgattttcagaaattcggtatttcagaagggtataaatcaaagaaatgagttaggattccgagtgtgttgggattactaagactaagttcaattgtgctgagaaatgcctatcaactgccagatagtgatgtgacttactagaatgacaaatcggttcgatccattaacctactagaaatcacaccccagtcttttccattatttgaaaaaatatccaagatagcttacaatagagagtagcatttaaaagtctttcagtttgcttttagtactaggcaacgagctgcgggctgtactggagtacggcacagggagttcaaacaatacagtgtattgtttgaagtgggaaatacggaaacgaagtttcctcaagtgttgaagtaataaaagcaaaccgaatgacgtaaagaaagagaaacttatgaaaatactagctttggacagctccaatcaggccttatcggttgccttggtggaggacggtcgtttgcaggcggaaaccctgttggctgtcaagaaaaatcatagtatcagcctcatgcctgtggttgattttttggtagcgcaggtgggctggacacccaaagacctggatcggattgtggtcgctcagggacctggctcctacacgggcctgcgggtggcggtggcgaccgccaagaccttggcctacaccctcaagatcgacttggtggggctatctagtcttcagtctctggttcctcctagcctgacgggtctggtggtgcctctcattgatgcccgccgtaactgcgtctatgcaggtgtttatgaaaatggcagagcagtcgagccagaccgctactggtcttttgaagacttgctttctagcctgtctggtaaggaaaatattacctttgtcggagaagtagaaaactttatggagcaaatcgaacaagctctaccgactgctcagtatcaagctagtctgccgtctgcctatcagctagcagtaatcggtcaagacttgccagcagtagatgtgacgagctttgagcccaactatctcaagcatgtagaggcagaagaaaactggctcaaggacaaccaagttggctcagaaagttatatcaagcgtgtatgatagagattaaacactacgacggtcaggaaaatctggcggaggctgtgttggcagttatgcagtccgtctatgatcagtcaccttggaccttggaacagattgtttcaagcatgaccagtcagtatgaggattattatttggcctatgagggtcaggaattggtcggatttttggctgtgcagacggtgctggatgagatggaaatcttgcagattgctgtcaagactgattttcagaggctgggaatcgccagtcaactgatggctgctgtgatggactgggatggggatattttcctcgaagtgagagagtccaatagcgcagctcaggccctctatacacgccagcattttaccaaaataggaaaacgaaaagactactaccgccatcctgtcgaggacgcggtgataatgaagagagaacgtgatgaaagatagattgattttggcgatcgagacctcctgtgacgagacctcggtggctgttttgcgaaatgacgcggagcttttatccaacgtcattgccagccagattgccagccaccagcggtttggtggggtggtgcccgaggtggccagccgtcaccatgtggaagtgataacggcctgtatcgaggaggccttgttggaggcggaagtgacggcagaggacctgacggctgtggctgtgacctatgggcctggcttagttggtgccctgttggtcgggatttcagctgctaaggcctttgcctgggctaacggtctgccgctcattcctgtcaaccacatggcagggcatttgatggcggcgcgggcggtcaaggagttggagtttccgctcttggctcttttggtcagcggtgggcacacggagttggtctatgtgtcagaggcaggtgactacaagattgtcggtgaaacgcgagatgatgcggtcggcgaagcctatgataaggtgggtcgggtcatgggcctgccctatccagctggtcgggtgattgacgaattggcacatgaggggcaagacatttatgacttccctcgggctatgattaaagaggataatttggagttttctttctctggtttgaaatccgcctttatcaacctctaccacaatgcccagcagaaaggggagaccttgtccaatgcggacttgtcagcctctttccaagcctgtgttatggacattctcatggctaagaccaagaaggccttggagcaataccctgtcaaaaccttggtggtagcgggcggtgtggcagctaatcagggcttgcgagagcggttggctgctgaaattaccgatgtggaggttatcattcccccgcttcgcctctgcggtgacaatgcaggtatgattgccttagcagcggtcagtgagtacaataaggaaaaccttgctggctgggacctcaatgccaagcctagtctggcttttgagaatttatagaataaaaacctcttacgtcaaggatacgtaagaggtttatttgtggatttttcgccagcgatttggagaaatttggtaatgtcttttaaaagcagttgaaaaattgaattggttggagtagccgatttcttcagcaatttcctgtagtgtcttagtagtgttttttaagagttcgcaggcttcgctgagtcggtattggatgataaattgttgaggtgagatgttcatttgctccttgaatagccgactgaagtagtggcgattgaggttgcacacttgtgccaaatcatcgacggatatagctttctcataatttcgttctacgaagttgatagcttctcgtatataaaattccttgttttcatcgtgtttgctacttgttttggttagcgaacagtcaatgaggcaggagataaagaggtaaaggtgtccgagaactagagcgcttttttgatgatggagcgcgagaatttgtttcatttcatggtagacagggctagaggtgggcatttctcgttgtgaaaagataggttgttctttcgagagccctgcctgtctgagaaaatgctcagttttcagaccgtcaaattcaagccagatataggtccaggggtccttttcgtctgcttcgtagctacagatggcgtctggggagataaggaagccctgtcctgcggttaggtggtattcacgttggtcggaggtatcgtaaaaagtacctgaaccagagatgatgtagtgaaacaggtagtgttgtttcatagttgggccgaatgagtgaagtggcttacaggcttccatgccaaattggatggggtaaaaatctacataggatctgttattaaagacgtaaaattcaggttgtattttcatcgtattctccataccaaaagtgtaaaggcttacaattagtatagcatatttatatgtaaatgtgacattttatttgaaaaaattaaaaaatatcccaaaatcatatggaatatgtcaaatattcctatttgattataaagcgcttacatgttatagttatagtagaaataacaaagttcgtcgacgtattcgacaaaagaaaaggagtattatcatgaagaaaattggtcgctatgttaccttgcttgcggctgcaggcctgctggcagcgtgttctacttcgactgagtctagcaaaactacgggaggaagtagttcaggaaagacagaaatatcctatgctatttgggattctggtcaagagcctggtttgagaaagattgcggatgagtttgagaaaaagaatccagatattaaaatcaatattcaagtatcggactgggattcctactggaccatgttagaagctggtgcgacaggtggttcattgcctgataccttctggatgcattcaaatgagatttatcgctatggttccaatgaaatgctattgccattggatgaatacttagccaagagtgaagatgccaaactagctaatttcccagatggtttgaatgaaatctacaacataaatggtaagcagtacgctattccaaaagatttcgatacaatcggtctttggtacaataaaaaattatttgacgaagcaggcattccatatccagatgatacttgggattggaataagttgaaagaagtagcgaagaaattgaccaagccagatggtagtcagtatggtttcggtgctggtttgagtaaccaagagggctactacaactttatctatcaaaatggtggtaaggttattactgatgatttgaaatcaggctatgctgatcctaagaccattgaggctttggattactactttagctttgtcaaagaaaaaatttcaccggctattacagtagataaagagcgggccgaagcattccaaaacggtcaagtggctatgagcgtcttcggttcttggaatttatctggtttcactgctaatgactacattcgtgaaaatgctgatgtagctgttttgccaaaaggtccagatggaactcgtgcaaccatctttaatggattgggtcatgccattgctgctaccactaaacatccagatgctgcttggaaatgggttgaatacctcagctcaaaagaggcacaagaaatgcaggcaacacttggtgtggcaatctcggcttataaaggcgcggcagatacttgggtagattcaaacaaaaactttactatcaagaattatgttgacatggtggattatgcacagattcgtccatattcacaaacaaccatcaagtgggaagataaggcttatgagctattgaaacctgcttatcttggagaaaaagcaactgaagaagctgccaaagaaacagctgatatgatgaatgctgaattagcaactgaaaaataggtaggaggtcttgggaagttgattcttccccggaccttcttattaaaatgaagaaggatggggataagatgttccgaaaaaaaggaagtttaaatgaggcaatttggggatggggaatggtagcaccgaccattattggattaatcgtgctcaatattattcctattttccaaaccatgaagatgagttttcataagagtggagatttcggcaaaggtgacatctttgtcggcttggcaaattaccaacgcatgttaggggatgcgcaagtgtggcaggcgacatggaataccttgaaatatacgattctagttgttccggctaccgttgccttggccatgttgcttgcagttttgcttaattctaagattaaaggtaagcatatttatcgaaccatttttttcttgcctatggtggcagcaccagccgcggtgaccatggtttggaaatggctctacaatacggacttcggcttgattaactatatcttgcgtcgtttgggactgggtgctgtgaactggattgaagatccaaagattgctctatactcaatcgctttgattggaatttggagtacggttggctatagtatgattttaattttagctggtttgcaagaaattccaacggatttttatgaggcagctcgcattgatggagctagtccggccaagcaatttttctccattaccctgccattggtttcaccaaccctgttctttgttgtggtaaccagtgtcattcaatccatgcaagtctttgatgttatctatatgatggaggatgttcgtagtcctgcctatgataagacagtatctctggtttatctgttttacaataattcctttaaatattcggataagggctatggctccaccattgtcatgttgttgttattgattattcttgtcattactttcgttcagatgaaggtacagaaaaaatgggtgcattaccgttaaggaggttcatgtgaaacaatcagcttttaaatcaacaatctggatgcatgccttcttgattttagtggcaatgggcatgctgatcccatttgtttggatggtgttgacgtcttttaaaacggtaaccgaatccactcagatgaatcctttccactttttaccaagtaactggatggtgagcaattatacggaggctattcggactaataattttccgatactctatctgaacaccattttgatgatgttatggcgtatctttagctcggttatgttttcagctatggcagcttatgcctttgctcgactggagtttcctgggcggaatttcttgtttggtctggtcctctttcaaatgatggtgccacctcagttattcgtcattcctcagtatttgatgattgaccaacttggtatgcgcaatacgatttttgctctggtattcccaggaattgtcagtgcctttgggacattcttgctccgtcaatttttcatggggcttccaaaagaattggaggagtctgcgaaattggatggttgtaatatcgggcagaccttctttaaggtcatgttgccattggccaagtctggcttgattgccttagcgatttttacggctttgtttgctttcaaggatttgctgtggccattgattatcaactcagaggctgacaaggctaccctatctagcgcactttctaagattcagggagcttacgctgttaactatcctcagctcatggctgcaagtgttttggctatttggccgatgttggtactgtatgtgatattccagaagcagttcatccaagggattgcgacatctggtggaaaattataggaggctacaatgggaattatctttcatgaaaagacaaaggaattccatctttacaatgagtttattagctatgtgttgacggtcttgcctaatggtcatattggtagtttgtattatggaaagcgtgtaacagaaacagcttcttatcagtatgtacgtgaagatgagtatcgtgctttgacttcctttgtagaagacgatgaccgtttcttttcgctccaatatgccaatcctgaatttgcttgttatggtacaacggactatttttctccgacttttgagttggtgcagaaggatggtagcagtctatcgcactttgtgtatcaaggtcatgcgatttatgctgggcgatcggctttgaagggtcttcctcatctctatctggatgaggagggacaggcagatagtttggatatttatttgttggatgaagattcgcagacccggctggtcttgtcttatacgatttttcgagattatccagcggtgactcgctctgctcgttttgaacaactcggagaaaaatctgtctgtttgaaccgtgccttgagtatgacactttgtctgcctgatatggactatgattggttgcatttggatggggcttgggggcgtgagcggcatctgcaactatcgcctcttcatcaaggttgtcagtctatttacagtctcaaaggggctagtagtgcggagcacaatccctttatggctttgaaacgcccaactgcggatgagcaacagggagaggtactaggcttctcgctcgtctatagcggaaactttttggcgcaggtggatgtgagttctttccaaaaaacaagagtgagtatgggaatccatcctgagcgtttttcttggacattagataagggagaagagttccagacgcctgaggttgttatggtttatagcgagcatggtttgaatggcatgagccaaacctatcaccgcctcttccaaaaacatctggtacgtggctattggcgtgatagagaacgacctgttctcttgaataactgggaagccatgagttttgattttgatgaggaaacaattctttccttggccaaagaggctgcaggtcttggtgttgaactctttgtcatggatgatggttggtttggcaagcgaaaccatgaccgagcaggcttgggagattggacggtcaaccgagagaaattaccaagtggcttgacagggattattgaccaagttcatgctatgggaatgaaatttggactttggatcgaacctgaaatggtcaatagggacagcgagctttaccgagcgcatccagactggattttccatcatcctcagcatagtcaatcgcacggacgccaccaatatacgctggatttgtcgagggaggatgtttatcaaaatattcatgaccaactccatcggctgttggctgagcatgatattgattatatcaagtgggacatgaatcgctatatgacagaggtctttacatgtacacgggaggcggatcgacaaggtgagaccttccatcgctatattctcaatctctaccgtttatatgatagcctgatagcagcttttccgacagtcttattcgaatcttgttcaagtggtggagctagatttgatccagggatgctctactatgcaccgcaaacctgggtcagcgatgacacggacgccatggaacgcttgaaaatccaatatggaacgagcatggtctatcctttgaatagtatgggttgccatgtgtcagctagtccaaatcagcagttggggcgtgctactccactaaacacacgtgccaatgttgcattctttggaagttttggctatgaattggatttgtttgagtgtagccaagaagagttggaagagatgaaagagcagattgccttttacaagactcaccgtaagattttccaacagggtattttcactcgtctgaaaagtccattcgatggagaaataacggcttggcaggtccaatcctcggatggtcagcaagtcatcgtgggttattatcgtcggttgacaacggctaatctctcctatcaacgcttgtatttgcagggattggaagaggaagcggtctatcaccttgatggagaagtttatactggtagccaattaatgcatacaggtttgtcgattcgacatggggaccatgttggagacaataaggactttacttcttgtttgatggtccttcagaaacaacagtagcatccctattcctaggcccagctatcggctgggtctattttatgcagaaagtacatcaataagggcaagacctctacttatactcttcgaaaatcaaaattatccgttgtcaacttgccttgatgaactccagttctatcttcggcttcgtttcctaggctacttttgattttcattgagtattagatataagaattcttgaaaaacgggttgcaatgtgagaaaatgagagaataattcttcaatcaattagtgaggggaagggagataatgaatgaagaaatatgcttttcgtgaagggatgcgcgatgccattcccactgtattgggctatgccagtattggtctagcctgcggagtcgtatcggttaattcgggcatttctactgtggagatggggctgatgagcctattaatctatgccgggagtgctcaatttgtcatgtgtgccatgatttttgcaggtgcgcctttgttatccattgcagtaaccgttttctttgtcaacctgcgtaattttctgatgtgcttgcatgcgacaactatttttcaaggaaatcgtttagggtcgaatatcttgataggatcctttgtgacggatgaatcctatgcagttcttttgcgtaagcagattgagcatcataccattactccagaatggatgtacggaaataattttgcaagctatgcctcttgggttacattcacgactctcggcaatctgattggtggtctcattccaaatcctgagcagtttggattggactttgccttggttgctatgtttgtcggtatttttgcaggtcagttagaggctatggttcggaccattccgctgaaaaaaattggcttaattctgctggcagtcggtctggcctatatcggtctgtctatgatggtgtcgtcctatgtggcagtgctcttggcgacactactaggttgctttgtgggggtgatgattgatgataaaaactaacattttactgattattctaatggcggccctggtgacctgggtgccacgcgtcctgccttttgtcctgacgcaaaataaatctctccctccaaagttggtgaaattcctcagctttttgccaatcactatcatttttgcattgaccctctccagtattatggatgagaaagttggctccttgccaagttttctccctgtggaaagcttagctattcttccgacattttttgtggttttgaaaacaaaaaatatccttttagcagtcttggttggcgttgttacaaccgcgttattacgtttgatattttaggaggtttttatggtaaaagaaaatgccaaaggtgtcggactttgtttccttttggctttggtgggtcagtggttaggtcatttatttccacttgtaggtgggcctgtttttgcccttctaattgggatgggtctgtatccctatttttcaagtaaaaatgcatttcagtcaggcttaacctttacttccaagaaaattttacagtatgctgtgatttgtttgggatttggattaaacttatcagcggtcttggcagttgggcgtcaatctcttccaattattctttcgaccattagttttgctttgattttggcatttctgatgtggaaaatcttgcccatttcatctcatctggcaaccttgattggcgtaggtacctctatctgtggaggctctgccattgcggcgactgctcccattattcaggcagatgatgaggatgtggcacaagcaatctcggtcatctttctcttcaatgtcttggcggctttggtctttcctagtctggcaacttggcttgggttttcgactgattcgggtcaggcctttgggatgttcgccggaacggcggtcaatgacacctcctctgtgacagcagcggcttcgacttgggatagcttatatggtctaggcagtcagaccttagatacagcagtgacggttaagctaacacgaactttagccattatcccgattacaacggttttagcaatttggcaaacccgaggaaagggtctcaaggcagacaagaagtccctcttggcaggttttccgacctttatcttgtattttatcttagctagtctaatcacaacgatagcgggtggatttggtataggggcagattggtttgctccgttgaagtccctctctaaatttttcatttgtatggctatggtggcgattggtttgcggaccaatgtgtttgccttggtgaaaaatggcagagcggctctcatggttggtctggtttgctggctgggagtgacggtgttgacactggtctggcaagcgattttggggatttggtaagagaaatgtgagtgggaaagacatcatttcctatttcaaacaatttttgagaagtaaatcgcagtgccgcagggctttttgtcgttcggtttttagtaccgttgaacaacttaaaactagttagttttgtttaaaatgtaattgaattgtctttttaagtaggctgtttacacgatatttgtcttcctttatataaatatgatagattttcagtaaatttttcaaaaaaacctcaaaaataacagattttttcttgtatctttgaggcataaggagtataatggtgacggtattcaagtagaaattttatatactctggatgaaaacattctgtctactttaaaataaataatctactgggtatccttctgctaagtttttaaagcaggaggtgtgtttttgtacatggtgttacaggaaccagaaatgatggcattcgccagtaaaatataggaggatatcatgtcttataaagatatgttcagaaaagaacaacgtttttcttttcgtaaatttagctttggtctagcttcggcagtcattgcaaacgttattttgggaggagcaatcgcaaacagccctgttgttcatgctaacacagtgacagaagcagagacagctgtagcaccagctaaccaagaccttggaaatgagactaaaacggaagaagaacccaaggaaccaatcgaagcagttcgcacggacatggaaaaccgtgcagctgaaatcttgccggaggcgctgaatgctagtgtaacaaaccaagcaccagttattccgactattggagatcttcctaaagatgcgagtggtcagaatgttcatggtaaggcaacggataataagatttatcgtgttgtatacgtttttggtaatgtagcagggactacggagacagaagatggtaaacaaaatgttgctccaacatttaacagaaatgatgcaactaaaacttttccaatcacagatccagatagcgacattcaaactatttcatacgaagttccagctgatattgcaagctataccttggatgatccaaactcaattgttactaatggcacctcacctggtccagtatcttacttagatggtccaaatgggtcagccactctcacacaagatggttatctaacaggaagtttcccttggggagcaggagacctagctggtcgtcggattaaagtgacggatgccactggtaatactactaagagtaatccgttctatatggttgcatatacagtcaagccagtagatgataaacctctagcagtatcaaactcttctgagctgacggaacaggctatttttgataagttggttgtcgataagtctgctaaaacaacttcaaatagcgctcttgtaattgattctagcaactacaaacattcaattgcaggttatcgtaccgtaaattctgatggcacaaaaacagaaacagtagaggaaacaaatctatctgatttcccaactgaaggtaaatacgaagttcgagtaaaaacaaccaatgtttacggtcaaactatctacaactggattcctgtaaatgcctataagttggacacagcgaaggatgctgaaattcggaagtatacagacaaccaagccccaattcatgctataatgcaaattggtcaagctggagaaaaggcagcagttatattgaaggatattccatccgatttcagtattgaaaacttcaatttgaaagatggtgtagcagatgagcttgctaaacgtaacttggaatttgtaagaaatgatgcagtggcgacaactgatactgatggagatggcgccaaagaaggaattgttggatatattcaaccaaaaactggcggtgcaaacagtggggtagccacttatacaggatcaaataatcttacttatggcttcacttacaaagctgttgagacaaaagataaggcgaatgccacagaggctaaaactctcgaattagattacaccatcttattcatagatactaaagcaccagtcatgacacctaaatcagagtacatccgttttgttggtgaagagtatacggttagcgtcccaggtacggataacgccttccttaataccggcaaactaaatggaactctctcaattttgaaagatggagagtcaggttctcttgtatcatcagacttaggtacaaacactaagattacttcagaactggatcctacgggagcaactgcaaaccaaggagatgacggtcaatcttcaactaagtttaacgttaagattacaggtaccggacctgctacagaaggtaccggcacttataagcttcgtgttggagaagataactatccttttggtccagaggggaaacttgttgatggaaataaaccagaaaatgtaggtttgacatctgtaaaagttaccttcgtaaaacatgctacggtgtcaacaccagtttctgttgaaaatccagctaacttaacgccagaagaaaaagccgcagttattgctcaaatcaagaaagacaacgcagacaacgaaagattgaagggcttgccagattcagcatttacagttaactcagatggtactgtgtcagttgactacagtgccggtggtgtcaatgttgatggtgcgacagacattattaagaatgctaccacaaacttggcagatacacggaatgaagcaaaagcagaaatcgacacaaaattagctgaacataaaaaagctatcgaagcaaaacgggatgaagcgttttctaaaattgatgatgacatttccttgagagcagaacagagacaggctgctaaggatgccgttgctgcagctgctggggatgctttgaaagaattagacaacaaggcgacagaagcaaaagaaaaaattgataaagctacgacggcctcagaaatcaatgatgctaagactaatggtgagattaatctggacagtgcagaagcagtaggcgaaaaagctattaaccagtcgaagcgcaatcggcagaggacaaaggcgtaggttcaatcgcccaagatgttcttgacgcagcgaaacaagatgctaagaataagattgctaaagaatccgacgctgctaagtcagccattgacgcgaatccaaacttgacagatgcagagaaggaatcagctaagaaagcggtagatgcagatgctaaagctgcgacagatgcaattgatgcttcaacaagtccagtcgaagcgcaatcggcagaggacaaaggcgtaggcgccatcgccaaagacattcttgatgccgcgaaacaagatgctaagaacaagattgctaaagaggcagaatccgctaagtcagtcattgactccaatccgaacttgacagatgcagctaaggaagcggctaaatctgaaattgataaagctgttgaggaagcgattgttttaatcaatggtgttagaacttatcaagagttggaaaaaatcaaacttccaatggcagctctaattaaaccagctgcgaaagtaacaccagtggttgatccaaataacttgactgaaaaagaaattgctcgtatcaaggcattccttaaagagaacaataacctcccataaggaacagagattaatgtttctaaagatgcttcagtgacaattaaatatccagatggaactattgatttgctatcaccagtagaagttgtgaagcaggcagataaaactgctcctacggtcgcaaatgatggcaaaggtaatattgtgattgtaccgtctgaaaaagctgttgagcttgttgtttcatacgtagataacaatggtaagtcgcaaactgtagttgttacgaaaggtacggatggtttatggacagcaagtaatacagtggtgattgtggaccctgtgactgggcaagtaatcgttccaggttctgttattaagccaggtacagttgttacagcatactctaaagacgaggttggaaatagttctgattcagcagaagctgaagttgtagcagtagacgaaaataattctgcagcaggagtgaaagttaaatcagttactacaaatgctaataatgttgagaagaaagctaagcaattaccgaatactggtgaggaagcaaattcagcaacttcactcggattagtagctcttggactcggattagcacttcttgcagcaaagagaagaagagacgaagaagcttaagataagctcttcctcagaactcttttggaagccgcaattttcctagaagatagtagtatgatactctttcatagcaaggaaattccctcgctatgattggtaggtatcagttattatctatcgaacccccaaaatccaaagtcattcgactttggatttttttgatacgacatgctcgtcatacctaaaaaacagccttctcttgcgagaggctgtttttcatgcttttaatctaaaagtctgcggagcttttttcaataaaatccagtaaccgatgctaacataggcaatcatagctagggaaaccagcaggatataggtgtggctacctacattgattcgggtgttgagataggccacccagtagagagcaccgctaagaaatttatagaggggattgaccacatccatgtcattggtaaaaggctggaggatatagtagataaagagatcgtggaaggaaaagagagcggtcagactgatgaggagcagggcagttagtagaatggtttccaaactaaaggcaaaccgccccagcaccatgatagccaaaaagaggctggtcgcaaagatgagattgagcttgcaggtctgcaaaaatcggtagttaaaaccagcgataatagtcttggcttctcgatagaagggatagtgaagcatggaaatatcgcagttaacaaagaccatctgagccaccaccttgcccgacgaagctacgtacataatcatgaaggaaagcggtaggaattggagcaagtaggcttccgtaaaggtaaacggatctaaaaagtaacgaatcccctccagggctgccagaatcacgactactgccaagacccagttctgcaccttcttatagaggacttttttgtagcggtcaaatagcagagcatttaagtaggtcatgccagacaggtgggacaggtcctttcctgttttcgcattgagttttgcctgcatctgcaaaccctggcgagtgtattcatttcccttggtcatctcaaaaagtttcttatccatttgcaaggactcgtccatacagtaggaaagatagtctaggtggttggtttgttgcttcaaataaccatagctaaaccaaatcagaaatggttggacaagcaggatagggactagcatgcctgaggagagctgattacggaagacaatagccaaaacatataaaacaaaaacaaacgcgatccatagccaagcatgccacgaattgcgacgggaaaagatacgacgttcaaagagcagacgattgagggcatggccagctagatgacctgccagcactgtcatcaaaccaataggaaaaactaaccactccttggttatcatgcaaaaaatggttgaggctggcaggtagtaaatagtggtcaggataggctcgataaaaagttggctttgaagaaagctggattgtgacaggctgaaattctgcataaattctcgatctgctttagagataacagggtctaagctcttccccaaacgatagcttagtccgacaaacaaaagccagaacataaagccaaggagccaagtgtttgggagaattttccaaaaggtcagctccccattgactagcatattcatccagaaagaagcatggtagaaatgaaagagcaaccagaagcccttgatcaggaagcgactggggatggataagatgtgcaggaccaaaaagagactagacttaaagctgtaagacttgaaaatactctctggaatgcactttcccacaagcggcagtttccgaagatagtagaagaatccattgactgaccgatggaggttatatttttcctgataccaagaataacgtaatattgttttcataggtttctcctaatctgctgtcagcaaggcaactacttcctgttcgaagtcaggatcatggagtttgtcgctcggaactgcttgcaattcttggtgatggagcaaaacaatctcgtcacagaggtcttgagccagttgtaagatatgggttgaaaagataataacggaatcctttttagcctcccgaatcagctgtttgaactcgtgggcagccacagggtcaaaggaagtcagcggctcatctaagagaaggacaggtggctggacaatcagggacaggagtagctggaccttgttctgcataccatgggaaaaatccttgagcagacggtgctggtcttcttctccaataccgaccaagtttagccattcttctggactgcgaggagatttgagtttatccttatgaatgtccatatagaagcggacaaactcataggctgtcataaaggcaggtagttgtggataggtctgggtaaagccgatgtccgtattatcgtagtcaagagtttcttcgcctttcacaaactgaatcgagccattatccaaggtcagattacgggcaatgcagttaaacaaggttgtcttaccagccccgttccgtcctagcaagccgtaaatcttgccttgttcaaattgaaaactggcatcctccagaatactcttgtgatcaaattttttagaaatagaagacagtttcagttgcatagccaatctcctttgttatattgttatggttttatcatacaataaaaaacaaaaaaattcaagcagtttttgcttgaatttttcagtcattaaataattagtagtgtactactcaaagaaaatcgaactcagactagctccaaaggttcggggaacctttggaggttggagataaggcgaacaaagttcgctacaaaaaggttcggggaacctttggaggttggagataggggaacaaagttcgtgccattagatgtagatagaacgctgtaccttttattttcgtgtagcaggctgtaaagctccactggagctttacactcatcaaatcaagtcaacaacgtctgagtttgatttatgaagagtaggaactaccagccacccagccagtcgcaaggcagtaggtaatgttaaagccaccggtgtgggcgttgatgtccaagacctcaccagcaaagtggagaccaggcaccttcttgctttctaaggttttgggattgatttccttgaggtcaacgcctcccttggtcacaaaggacttggccagggacatcttgcctgtaatcttgataggtaagactttgaggagggtgaccagttcagtcaggtctttttgggaaacttgcttgaccttgctatcgtagttttcagcgaaaaagtctgctagacggtctggcatgagttcagaaagggtattcttaacggatttttccctgttcttttctaaatgttcaaacaggtcttggtcagaatgggtcggcaatacatcgagaaatgcggtttcgccgcctttgacaaaactggacaagcgaagagcagcgggtcccgacaggccaaagtgggtaaagagcaggtcgtgggtgatgacgtgcttgccgtaggtcagggtgacgtcgtccagggaaattccttggagcttcttgtgggggaagtcggtcaggacggggctttcagcggcttcaatctccgtgacttccagcttgaagtggcgggcaatgtcgtgtccaaaaccagtcgatccggtggaaggataggtcttgccaccggtggtgacaatcagctggggagctgtaaagacttcctcgctggtcttgacatggaagaggtcatccatcttgcggacggacaccacctcagttcctgtacggatgtccacgccattttccaacattttcatctccaggcacttgataatggtctgggagcggtcggtggttggaaagacacggccgtggtcctccaccttgagcttgaccccgttttcctgaaagaaattcatgatgtcatggttgtcaaactgagaaaagacgctgtacagaaagcggccattgccaggaatgcctgccagcaagtcttccagtgtgccgttgttggtcacattgcaacgtccgccgcctgtgccagatagtttcttgcccaaacgcttgtttttttcgagaagcagggtcttcttgccataaaaactagaagaaatggcggccatcatgccagcaggccccgctccgataataatggtatctactgtattcatgcctttattgtatcatattttcatcaagaaagtagtttgagtctttgctatgatttgtggagtttttccttgagattgcggaagaccattgacgggttaggggagtatacttaaactaagggaaattagtttttatcaggagcctgtatgtacaagcaaagtaattttgtggaaactgcattgtgaaaccaggttctaacaactccgtctgtagcatgaaagaaagtaggtagaagaatggtaactgagcaaagagagtatcgttttccagaaggttttttgtggggatcctccacttcagggcctcaaagtgaaggaagtgtagctggtgatggaaaggggtggaataactgggattactggtacagtcaggaacctgagctctttcaccagcaaataggaccggaacaaacatcgactttctatgaacatttccagtcagatttggatttgttggtggaaacatgtcatagtatttttcgcacctctatacagtggtcacgtctgattccggaagggataggcgaggtcaatccgcaagctgtggagttttatagggctgtatttgcaggtattcgagagcgtgggataaagcttttggtcaatctttatcatttcgatttgccttatgtcttacaggaaaaagggggctgggaaaataaggagattgtctgggcctatgaggcttatgctcgccagtgtttcagcctctttggggatttggtggatcattggattacctttaatgaacccattgttccagtagaatgtggctatctaggaagctatcattatccttgcaaggtggatgcaaaggcagctgtggtcgtagcgtatcatacgcaattagccagttctttggcagttcgggcctgtcaccaactacacccagaccacaaaatttccattgttctcaatcttactcctgcctatccaagaagtcagagtccagaagatttacaggcagcacggattgctgagctatttcaaacgagaagctttttggatccatccgttttgggacaatacccgagggagctggttgacattcttgaaaaacacggtttacgtccagaaaccacagaggaggaattgaccattatcaaagaaaatagggttgacttcctgggggtgaattattaccagcccctgcgcgtgcaggctccttcagaagatggatggaacggagagcctactttcctatcccaatatttccagccttatgataagcctgacaagaaaatcaatccccatagaggctgggaaatttacgaagaagggctgtacgatattgctaaaaatatccaggaaaactatggaaatatcgaatggttggtaactgagaacggcatgggagtcgaaggggagggtgtttttgaagaaaatggcatgattcaggatgactatcggattcacttcatggaagaccatttgattcagctccatcgaggtattgatgaaggggcgaactgtaagggctatatggtctggacctttattgactgctggtcttggttaaatacctataagaaccgatacggtttggtctcgcttgaccttcaaactcagaagcgtactgtcaaaaaatctggatattggttcaagcaagtgagtgctaaaaatggttttattagatagaatgtatatttcgtttctgcataacattgcattgagataagatgcttttgaggtttgtgattattcactaatgcttggtaaggaaattcccctagatttgacagggatagggttctgtggtaatattttaatgatacaaactatgagaaatgtaagtaccgaggatattatgggaatcgaaaaaacagtcagtgagttagctgaaattttaggagtgagccggcaggctatgaataatcgtgtcaaatcacttcctgaagaatttgtagataaaaatgacaagggtgtgaccgttgtaaatcgtgctggcttgattaagttggaggaaatctacaaaacaaccatttttgaagatgagccgattagtgatgaagtcaagcatcgtgaattgatggaaattttagttgacgagaaaaatgctgaaatcattcgcttatatagtcaattaaaagctaaagataagcaacttgccgaaaaagatgaacaactcaaggttaaagatgtgcagattgctgagaaggataaacagttggatcagcaacagcaattgacactaaaagctatggccgataaggaagttctcaagttggaattggacgaagttaaagcacaggcagaagaagtgcaagctaaaggcttctttgcacgtttatttgggaaataaaaaggtccgggggacctttttatcatgagcttgaaaacaagagagcgaataaaggtccgggggagtgaaacagcctggggatagactgtttcagcccgagctaaaaactggaaaatgatatgtgatataaaaagattggtgggaaccaatcttttttagtttaagtagtgagcacaattgaatttttatttttcattatattaattgggctcaaagactctagaaatcagaaatgaaaagggatacaattaagacaaggaggaaaatatggttgataatcgtaccatggcgattctgatggaattgtttgcgactcgaaaagaaagtttgtacgaacttagtattcaaacaggaattgaaaaggagcagctacattctaatttggaactagtcaatcaattgttgcaagaacattccttcccgcagatacaatacaaagatagcgagtttgttatttctacggagctttacaatcaaaaagaaagtgtattttcgctctttcgcaatcgccagatctatctttcgcaagaagaaagacagcttcttatctatctttatacctttatccgaaaagaatttgtatcaaacgttcactaccaagaattattgagtgtgagccgtaacacaacattgacggatattaagaatgtaaaggaactttgcttggactttcaagtacgattggaatatacgagggcgaaaggctatcatctaattggtcgagaagaagataaacatcgcttggcgctttatgcactcagtaattgtttgcagtcttcgattggtgtgtgggctttggattatattcttaaatcttggggtgaggaaaatcctattgaagaattgaaaatagtgagtcaacaagcttgcaattattataaagtctcagctttagaagagagattggatgaatatttgtattttttgatatttttatttatccgtcaggcgcgtgttggcaaccgtattaactggaattttgaaggaaagggagggtttgtaaaagattttctgcaacgcctttggaaattattacgtttaaaaagtactagcacattagaattaaatgctgcgacacaagagtatctgtcacatttactgcaaggatgcttagaaggtgagagcggagaaaaggatgatctattttaccacttgactgtagaaatagtggaagagatggaacgtttgtccttaattacttttgaacatcgctcggaaatgattgaaggtttgcaacgtcacctaattcctgcttactaccgtttaacatctcgtttggtaaatgtcaattcatatactgaaaccatcaaagaagagcatgccgacttgttctatcttgtaaaaaaagctttgcgacctttggaagagcatctaggttttactataccagatagtgaggtatcttattttgtcatccactttggtggctacatcgaagcaggtcaacaacgttcatatcgttatcgggccttggttgtttgcccaaatggagtgagctcttcgctgattgtaaaagaaaatctacggcaactatttcctaatatctattttgccgatacccattccttacaggattggaagatgctagacatgacagactatgacatggtatttggaactatcaagctgaatatagagctaccatttttcttggtatcccagctgatgacctctaatcataaaaaagaattatttcatttggttaatcagcatttcccaaatgcggcttattttccgattgagattgagcagttattatcacttgttgggaaacatgcaaccattcatcaggagcaggctttaaaatatgaattggtgcagtttctcaatcaacgctcccatgagcaaaggggaaggagtcctatgttagaagaattgattacaaaagagacctttcaatggtctgaggaagttttagactggcaaaaagcagttgccctggctgcacgacctctggtagataaaggagctatagaaactcgatatattgatgctatgatagcgaaggtagaagagtttggtccttttattgacctaggtaaaggaattgcgattccacatgcacgaccagaagatggggttaatgaggtagggatgtcaatgttggtattggataagccagtttatctattggatgaccctagtcatgaaattcggctgttcatttgtattgcagccgtggataatcaaacccatctcagagcactctcgcatttgacaaaaattttgcgagaagaagaaaatattcaacaacttgtcggcaccaaagaattcgccgacgtacaacatttattaaaggaggaacagtaatatgttacgaattggaacagcctgtggttcaggtttaggctctagctttatggttcaaatgaatattgaatccattttgcgagatttaggtgtatcagatgttcatgtggagcattatgatctaggtggtgccaatccgagtgaagcagatgtgtggattgtcggacgtgacctggctgattctgcaactcatttaggagatgttcgaatattgaatagtattattgatatgaatgagttgagggaacttgtcacggctatctgccaagaaaaaggtttggtttaaatcgtatacacaggggatgacccgcaaagataaaattataaaggagacagaaaatgatattggattttctcattgatattgctaaaactccggcaattctggttgctctcattgctattctaggtttagccttacagaaaaagcctgcagcagatttagttaaggggggcttgaaaacttttgttggttttattgttgttggtggcggagcgaatattattgttggctcgcttgagccatttggtcaaatgtttgaacaagctttcaacttgaaaggggttgttccaaataatgaagctattgtagcgatggctttggataagtatggaactgctacatccttgattatgttgcttggaatggtcttcaatattgctattgcccgctttacacgctttaaatatattttcttgacaggacaccacacactatatatggcctgtatgattgcagttatcatgagtgttgcaggattcacttctgtcggcctaattgtgatgggtgggttggctttaggtctgattatgacactctccccagccttcgttcaaaaatacatgattcaattgacaggaaatgatcatgtcgccctaggtcacttcagtgcacttggttactggttgagtggtgtagtaggcggtttggtcggtgataagtctaagtctactgaggatattaatttccctaaaggtttggcattcttgcgtgattcaactgtcagcattgccatttctatgtccttgatttacatgattgtggctttgtttgcaggcggtgattatattaaggaaaaccttagtggtggtactaacagcatgatttacgccttgaccctaggtggaacttttgcagcaggtgtttttgttatcttatctggtgtacgcttaattttagcggaaattgttccagccttcaaaggaatttcagagaagttggttccgaattccaaaccagccctagactgtccagttgtttatccttatgcaccaaacgccgtgttgattggctttatctctagttttgcaggtggtattgtcagcatgattattcttgccttgactggcggtgtcgttatccttccaggtgtcgtaccacacttcttctgtggagcaactgcaggggtcatgggaaatgcgtcaggtggtgttcgtggcgcagtttgtggtgcttttatgcaaggggttctcattagtttcttacctgtattcttacttcctgttttgggagaccttggttttgctggttcaactttctcagatgcagactttggtctttctggtattttcctgggagtgctagctaagaatggcggtatcctcacagtttcggttggtatctttgctgtcttggctttgatgcttggattgtcattggtgaaaaaagaacagaaagaaggataatatgactagtggtacagctgatttgaaacgatttgccaaagaaattcgctaccataccttggcgactttgaatcaattaggattcggtcattatggtggtagcttatcaatcgtagaagtgttggctgctctatatggagaaattctggacattcgtgtccagaatttctcttctaaggagcgggatcactttattctgtctaagggacatgcaggtccagcactttatagtacgttgtatttgaaaggcttctttgatagagattttctcttgtcgctaaatcaaaatggaacacatttgccttcacaccctgaccgaaacttaacgccaggggtggatatgacaacgggttcgttggggcaagggatgagtgtcgcgacaggtgttgcttatggtaagaagatagaacagtcaccgtactatacctatactctggtaggggacggggaattgaatgaaggtcaatgctgggaagcagctcagtttgcagcccaccacgaactatcgaaaatgattctgtttgtggatgacaataaaaaacaactagacggtcgtacccatgatatttgccaaacctttgattttgttgaaaaatttcaggcttttggttgggaatcagtgcgtgtgaatggtgccgatatagatgctattataaatgctattctaacaatgaagtcaagtaagtctcctcaaccaaaatgtatcgttcttgatactactaaggggcagggagttaccttcttagaagaattagaaagcaatcaccatttgcgtttgtcgggtcaattacgggaagatttagagcaagtaacacttgttttagcgagagagttggaggtgacggaatgagacagacaaaggagatgcgactggtttatagtgattttctagctcaggtagggcaggaagacacaaccatagcagctattgaagcagatttatccagttcaatggctaccaacaaattgtcctctgttctggggggacgctatgtcaatgtaggtatcatggagcaggaaatggtaggggtagcagctggattatctcttctaggatacaagccatacattcataccttcggaccatttgctagtcgtagagtctatgatcaggtgtttatctctctagcttatgcccagctcaatgccacgattgtagggtcggatgcgggggtatcagcggagatgaatggtgggactcacatgccgtttgaggagctgggcttaatgcggctcattccaaaagcgcgtgtttatgaggtcagtgacgatgtcctgtttcaagctgttcttaaagaaaccatcaaggtagacgggttgaagtacattcgtaccattcggaaagcgccaacgcctatttatcaaggtggagaagattttagcaaaggctactgtgtccttaggcaaggggaggatatgaccttgcttgcgagtggtattatggtagagcaggcattaaaggcggcggatcagttagaggctcaaggagtatctgttcaagtcattgatctttttcgtatcaaaccaattcatgaagacatatcagctctattatcaggaaggccagtattaactgtagaaaatcataatcgaattggtggcctaggtagtagcatttgtgaattaatggctacagatttaacgaccccagtacatcgaattggtattgaggaatcttttggtcaagttgggcaacaagcttacttaatggatgtatatggtttgacagcagaatatattgttaaacaagcacaattaatgttacaacaatagtgagatagtgattcgtattttatgtagcctttcgatttactttggcttggaaataggaaagcaaatcaaatgtaagaaatcaagctccacttaggaacttgattttttctatacttcattcattgctttcacaatcttccatccttgatgaaggcttgcaattcttgctagaatatgggacactagaatcatgaaaaagatacaacgtgaatttcaaaaaatatattacaacttagacaagattctcttgctcttctttaccctgtttacctttatggaatttgtttggataccgctcaattcatggatttctgagggactcttagctatgacagggcatgcctacctttcaccgacgaatttgttgtcggtgtttgctgaaaatctgctcgtgacaggcttgtttattctcctcttttttgtcaacattgccattgcctatctagaattagctctattgttcacaggggtttggcaactgttggatgaaaaagtcaagcacctcaccgactatttacgggatgtacgagatagtatggtggcgattatccgtcacagtagcctaccaaaggttctatttctgctcttttactcagttattcttcttccatttttacgccgagtattaaatatctattattttaataaaatcgtagtgccccaatttatcgtagattacctatccaacacagtctggctaggaatattgattttgattttcctcctcttgttcttctggcttgcggcacgcttcatgtacgctctgccaaacatttattttgaacacaggggtgtgaaggagtctatcgcttattcttgggagaagaccagaggcagaaagcagatcggttcattgttccgtctaatttggttggttacttttccagttctcctatttacaggagtaggaggactattctatcttgtgcaactgttagcagagcattttgtaccaagtgcttcttactggctggcagttgtctgttacgcacttctaaaattagcctactacggagtagttgcactcttcatgatgggatttgtcagcctcctaacaggaaaacaactaccaatctaccgccgtaaacgcctccgtcatcaccttcgactagccattttgctcgtatctggtctggtgttcggtacccaaggagcgcttgccctctactttccctttgacactctgccggttaccatttctcaccgaggtgtcgatgacggcaatgctgtccagaactctatcgaggccctagagaaaacctctcagctcaagccagattatattgagatggatgttcaggagacgaaggatggtcagtttattgtcatgcatgatacggatttattggctttgacgggcaatcccggaggtacacatgactatactcttgcagagttgacagggatgactgcatcagaaaacggcatggcagctccagttccttcttttgatgaatatcttgaaaaagcggatgagctgggacagaaattattggtagaaattaaagtgaccaaggcagattcgccaaaactcacccagaatttcttaaaaaaatacggtcaacgtttgattgccaaaggacaccagatgcaatcattagattaccgtactattatcgaaataaagcagtatagcgagaaattagtatccttctttattcttccgttcaattcaatttatccgacgacggttgctgacggctatactatggagtatacctcgctggatcaaaattttatgaccaagtcttggattcgagggaagtcggtttatgcttggacaccgaatgaagaagagagtatgaccaagatgttgctgctacaagtggacggtatcatcactgacaacatgaccgacctccaaagtctgatggaggaaatgaaagagaatcgacgctatccagacctctttttccagcaatttcagtctttgatttataattttgaataaacaaagagacgcgagggcctggcccaatcgcgtcttttctgtcttaaaaaggtaatttacctgcaaaggcacctagttttttctgagttgcctcgtcaacttttgtaagtgcagcgttgacggcttggattgtcatttcttgcaaggtttcaaggtcgtctgcatccacaacatcagccttgaagtcgatagaaaccaatttcttatctccagtaaaagtagcagtaaccaagtcttgtacagagctaccagtaaattgagtagcagccaactcagcttgactcttctccatttgtttttgaagtttttgagcttggcgcatcatgttttgcatgttcatcataagatttttaagattcctttcgtatcaaggggttagaccctgtttgtaaattttccttgccttatgttaaactttttcaaaggcagaggggtagtaaatattataacatgttttatgtagataatgctaccttcttaaaataagttatagtcagcaatatcggatataaatttgacatattaatctattttaaattgactttgagggataaattcgctataatataagaaaaactggttataaccagaaatcacggaggaggagctatgttccgtttagcaaaagaagaacttgaaaagttgggagctattattacggcgaccgaaatttaccaacagccaggcttatggaaggaagcgtatcaactctattttgaccaattggaaaaaatcgagagttttctaaaatcaatcaaggaaaaacatgactttgttcacgttgtttttacaggtgcagggacttctgactttgttgggcaaagtattgccaactacctcaaccaagtcaatgacttgaaacacattcgtttttctgccattggtacagtggagctggttagtcgcccacatgactatttacaggcagatgtgccaacggttttggtatcctttgcccgttcagggaattcaccagaaagtgtggcagcagttgaagtcgctaagcaattggtagataaattgtatcaagtgaccattacctgtgcacccgaaggtaagttggcactagcggctgaaggagatgctgaaaatctcctgctcttgcaaccggctggatcaaacgataagggctttgccatgacaggttcttacagctgtatggctctgacagccctcctcgtcttctcgtcagccagtcaagaagaaaaagctgcttgggttgagatcattgcccgtctaggtcaagatgttttggaccgtgaagactacgtgcaagacttgattaaccttgattttgagcgagtgatttacctcggttcaggtggtttctatggtcttgcccacgaagctcagttgaaaattctggaattgacagcaggtaagattgcgaccatgtacgagtcaccactcggtttccgtcatggaccaaaatccttcatcaatgaaaagaccttgattttcctctttgcctcaaacgatgcctacactcgtcagtatgatgtggacttgcttaatgaagttcatggtgatggcatagcagagcggatagtggcattgtcggctgataagttagtcggtacagaagcagccaactttgtcttggcagaaggcggagcagatctgccagatgtcttcctaaccttcccttacatcctctttgcccaaacggtatctattatggcagccattaagtgcaacaacttgccagatacaccatctccaacaggcaccgtcaaccgtgtggtgcaaggtgttatcatccatcctttagaaaaataggcagatgcattcaacgatgaagaaacagagctattcggtagagttttaacacataaaaaacacatccgaccacctgaatatcatggtacaataataatatataataaaatatgattaggacttatagaaatggaaactgcaaataaaaaattcagatatagtattcgtaaatttaaagtcggcgtaggctcggtgctgattgctacttgcttacttggtgcgggagtctcgacaccaaccgcttttgcgacgacagagacttcaacagctactcaagttgaagcaatggcgaaagttgaagaagttcagaagcttgtgaaagaattagaaaaagagctgggggaactagataaggttccaagttatggtgatgctcaagattattcttatcagaaggctttgtgggaagagtttttaagaattggaaaagataatatggactatgcttcaaaaatgaaagcagatgacaagtttttccataaggttaaaggggatttgaatgattttaaatatcaaataaaagtggaaaactatatccgtcaggttgcagaattgcgaaagaaataccctggtgataatacaattgaggaagaatataatgcgcatttaaagcaagacgaaggcaagagtatagctagccaagagggcgctaccttaagagactacgttgatagagaagcaagtgaggccatgggcagaattaagcaacgagttgctgaactggaaaaatcaaaacaaccccagccaagtcccgcagatgagccagctccagctccaaaagaggaagaaaccccagctccaaaagaggaggacactccggcaccggacgcagccccagctccagctccaacaccggaagtggatccagctccaactccaattccagacactccaaaggcagaggaagaggctccaactccagtaccggacactccggcaccgaaagaggacgaagttccggcaccaattccagacgctccaacaccgaaagtagaagaggaaacacaggagccgaaaacagaagagaaggcaccagagacgaaagaagaaactccaactccagtaccggacactccggcaccgaaagaggacgaagttccggcaccaatgccagatgctccagcgccgaaagcagaggaagaagttccagccccaactccaatgccagaaactccaatggacaaaccgaaaactgataaagtagagtctgacaaacagatgccagaggctaagcaaccagaaatggagcaaccgaaagcagaagacatgccgaaggaggaaatgccaaagtctgagcaaccaaaagcggaagactctgcacctaagacagcagttccagaagtcgcaccaaaaacagcggaaaaaccaaagctagacttcacaacaaaagaacgcaaggtagaagaagctctccctatcaaagaagaaatcagatatgatgcaagcctaccgcttggcaaatcataccttcttcaagaaggaaaagcaggtaaaaaagtatctgtttatcaagatgtcatagttgatggtaaagttgtcgcaaccaacctattatcagaaactgttgttgaaggtcaaaatcgtatccttgtaaaaggtagcttggaaatgaagaaagaagaagtaaaaacaactccttcagtacaatcaaatccgacactaagtcataagggcgcaccttctgcaaacaaagcaaccctacctgcaacaggtgaacagcgcaataacctagccttagtaggccttggtttagctggaattagcttggcggtagtcgctacagctataaacaaaaaatctaaagatcaaatctaaaccattatgaaataataaagaggcagggcggaaacgcccagcctctttttagaactgaaaatcaatattatactcttcgaaactcaaaatcagacgttgttgacttgatttgatgagtgtcaagctccagtggagcttgacagcctgctaccataaaataagaaagtagcaggggtatatctgctcttggagaaacgaacttcgttcactctatctccaaccttcaaaggtttccaaaacctttgaaactagtctgattttgattttcattgagtattagtgcggtaaaattaactgtgattgacttaaatcaaggtggatttgccattgagaattatcccgaacagtacactcaaagtcggttgtatagagaatcaactccaagacatcgccttttttcagctgataaatggtcggctgcagtttccaggtcagattcatccactgtccaggcaccacttcctcgacagtcatcaggtcggtgcggttttgcaggttcataaagcccttggttaccaagcgttgtggcatctccacatagggcaactccaccagattttcttgggcatggtaacgaccgttgtctagactcaatcttgctttaggcgcagggattggggctaggcgttttttatttcccttgtccaatagctgagcggataagaggcctttagctacactagaagcgacacggagtttcagcgtgacctgcccgttaagcaagaggccctccgttacaggcagttcaatgctgatttgattggctttgcctgcatagaggtcttggtggaaggcagagtaggatttgccgtagcgttcaaaatcttcttgggtatactgattggcaacggtctggcttccagtacctagtggcaagacagtctcgttttcaccgccaaaggtgtccaaggtcgtccaagtttgctcaccgctgttgtcctgccagataaccgttggcagttggtagttgttctcgtagcccagtagtttctgactgagcagggcgttcatggactcgcggaagtcgatagactgccagttgttcatataaacgtgggcaccgttgtggaagaagaggtgcttcttgatgtgactaggtagggcatggaacatattccagacatggattggcttgacattccagtcctgtgagccgtgggtaaagaccacctcacacttgaccctatcagcgtggagcagataattgcggtcatgccagtattgattgtagtcaccgctggtgcggtccagggcagcacgctcggcagccagtcctttttcgtaggctgctttattgcggaggaagtcacctgcttgcaaactcttggagtaggtcagggcggtcaagctgtccaaatcttcgcctggatagccaccagggctggtcaccagcccgttttcacggtagtagtcataccaagaggaaatccctgcttctgcgatgatgacttccaatccgtccacgccagttgttgccaaggcattggacatggtaccgagataagacagtcccgtcgtcgctaccttaccattggcccaatcggccttgacctcaagcgagcgagtgtggtctgtgtaggccttggtgcgaccgttcagccagtcaatcaccgctttatagccctccacctgttggtagtcgccagatgtcatgtagcccgtcgagcccagcgtgccaacaccagacacatggaggctggcaaagccgcgagcgaggaagtagtcattgagggagtacgaagtaatgtgccccagtttttcagtagcagggctgacaggcaggttccgttggtccaagtctaacttggtgatgctggcctgcttgacctgaatggtaccgacttgtttttcagccagttccccttccatcttatgcagagccttatcgctggctacatcgttaactccttgatgataaggactatttgtaatcaccgcagggattttcccgtcaaagtgaggacggaggatggacagcttaacaatatctgtctgcccagtcccagctgtatcaacaggcgtttcgacatagaccacctcacgaataaggtttttggttgaaaaggttgccatagatttgccgttgaagaagtggtagtgattgtcctctggaatcaggtcatcgctgactagctggtcaatcaaggtgtttccagacttggtgcgagtattgaggagctggtagaggttgtcaatgatgtccccatagacaatcgggaagttgcttttctccacgaaatccatgacatctgtataatccataccaggcacaaagcccagcaactgaaaggcgacttgatagaaaatctggtcagtcaactcacggtcagactggaagaaggtcagaagatctgtgtcccattctgcgatcatgtttgacagggcaaagtcggtgtttgctgtcaggaaatggcactttctgacaaaggtttctaaatttgtcttactacttgcatcaggaatcagttgaaatcccagagtatcaagttcttgcaagtagacggaggtctctttttttatgaaagaaaattgattaaagcgcataaattctcctcttttttaggataatagtctataatagctattatatcggataagtcaatgtttgtctaaaaattatcagtatatatagagatattaatgtataaaacgacgatacaattacttgtaaaatgatgaaaatttttatacaatattgtagaatgactgaggagtgaaatgtatcgtgttgagaaaaaatgaagctatagtccctattttacgtattaataatagggctattaaccaaggatttttagaagaaaatctaggaatgaaaaccaagctcgaagatggtccttttgctgattttggagatagaacaagtccagaagcgaagctcgttttgacagaatctcctggtaatcgcacccgtgctgtcgaagggcttaaaaaactgaataaaattgtgataaaagtagacaatgcctctgaaattgaagctttactggcgcaagggtcacagtatagtaagctctaccaaggaaaaaatggctatggttttgaagctctttcgccagaaggagacacctttcttttacacgcagaagcatctgttgatgacctaaaagcaatccttccacctgttccatttaaggtgcaggatgacttttctggtctgaccgcttttacagtagagtctgtctggattaataccccacaagctagtattagtcaagactattatgaggctatcctacctcaacaagcctttttgcgttttgttggagcagaaggtaaggatttattaactcctgcagaacaagtttgggatttagaaggcttgcgttttcccgtcgagcaagactttgattgggcgcatttggaaagccggttggaaagaccattctttaaagataaaaaagcgagctttatccaaacagttgacccaagtggtattgaattgtggttcgaaaaatgagacaagtaattttagacaaggtttcagagcagattgagcaaggagtatatcctggtgtcagtctggctttttttctgatggtcagtggcaggagtactatctagggacccaggatgggcatacgccagttgaggcgggtttgacctatgatttggcgtctgtttctaaggtggttggagtagggactcttgcgacttttttggttaatagcggagctttggagctagataggaccttgcagtcttattatccagcttttgcggatagtgaggtcaccattcggcaattattgacccatactagtggtattgatccctttattccaaatagggatagtctggatgccgaccagctcaaggaagcgattttgaagattgctgtaacggataagaaagctttcctctacacggatattaattttctcttactgggctttttgttggaggaattgggtagagacagtctagaccagctgattagtcgagacgttctagagccctttggtatgttccgaacctcctttggaccagtcagtcaggcggtgccgacggttcgtggcgtcaaagcaggtgtggtgcatgatcccaaggcgcgtgtcttgggcctccacgcgggaagtgcaggtctcttttcgaccgtcaaagatttggaaatctttttggagcgctatctaactgaggattttgcggcgaatttaacgcaggattacggttttgatgataaacgcaagcggtctctggcttgggataagaagggggactggttgtcgcacacaggctatacggggacctttatcatgtataaccgtcccttgcagaaagctgcgatttttctctcgaatcgtacttttgacaaggatgagcgcgcccagtggaagttggatagaaaccaggttatggccttgattcgtcaggtcttggaggaagaagaggctattgactaatactcttcgaaaatcaaaattatccattgtcaacttgccttaatgaactccagttctatcttcgacttcgtttcttaggctacttttgattttcattgagtatatatcagtcatttagtttttcttttattacttcgacgatcgaggaaacatcgtttccttatttccaacttcaaacactccactggagtatttgaactcgctttgccgtactctgcaggggggacttgctccgcaagtgctatctccaaccttgcacagtcactcgactgtacaagctgtccgcagctcgttgcctagtactaaaagtaaactaaaagactataactatccttccgcaacactcagtagatttttcgacatagtaaaaggacctgcatgtgcaagtccttttgtgtctgcttgattaagcttgacctgaaacttcagcagcgtggtcgtccattgaaagaacttcgtggaagacacgttgagtcaattcagttttttgctctttagtgaggtatttagtgtttacgcagtatccagagatacgaacgataacatcttcaccagccatgattttttcataaacgtcgttcaagtccataacgttcaagttaacgtgttgaccaccttgctcaaagtaaccatcaaggattgttaccaagttgtttacttgctcatcgaatgttttaccaagcgcttttggagaaacttgagtagtcaatgagataccgtcgttggcatgtttgaagttgagtttagaaagggtattcaagttttgcaaccaaccaccacgagctttagaagttgggttagcacctggtgggaagaattctaccttagtagtgttcacagaaccatcttcattgaggaatacaccacggtgaactggagagttacctgtttgtttagagtaagcaacgttagaagtgattgtcaagatagatactgtagcttcagcattcttgtacaatttatgtttgttcaaacgagtgaagaatgcttccatgagccatttcgcaatatcatctacacggtcatcgtcttcaccatagcgtgggaagtcaccagttacttcgtagtcgtagataaatccatcttcatcacggattggtttaacttgtgcatacttgattgctgacaatgagtcaacagtgtttgcgaaaccacagataccgaagcccatgttagcacgaaggtgagttggcaagaatgccatttgaactgcttcgtagttgtatttatctgtcatgtagtggatgatattcatggcatcaacatatgtatcagtcaaccagtcaagggcgatttcaaagttcttaaccacttggtcgtagtcaaatacttcagatgtgtttggttcaacaccgtcgaatactttgtaatctttgtgaacgtcatcgtaaccgttgttccagcttgaaagaagggctttaaggacgtttacgcgagcaccaaagtattggatgttgtggcgttggtcttcgctttctggatcaagtggagatacacagcaagagatacatgacatttcaccataaccatctttcgccattgttgtcacaccttcatattggatagaagagtgtttgtggctcattgccatacagtagcgacggaatgaatatggaagttggtctgaccaaagaactgtcaagtttggttctggagagttaccgatgttgtcaagtgtgttcaagaaacggtagtccatcttagtaacacggtgacgaccatcgttacccatacctgccatagatgttgtcaagaatgttgggtcaccagagtagatttcgtcgaaggcttttgtacgagcgaatttcactgtacgaagtttcaatacgaagtcatcaacaaattcttggatttcagcctcagtaaatgtaccacgagccaaatcacgttcagcgtagatgtcaagtacgattggcacacgaccaagagaagttgctgcaccgttgataacacgacatacagccatgaaagcaatgtttgtccattggatagcttctttagtgttcattgcaggtttgcgaacatcaacaccatagtgatcacctaagcgtacaacttgttgcaatgcttggtactgcatgttgatttcttcacgaagacggattgattcttcatcgatttcagtaatggcattccagtcagctactttttcttccatcaagtagtctgcaccgtaaagtgccaaacgagcgtacataccgatgatacgaccacgtgagtatgcatctggaagaccagaaacgtggtgtgagtggcgagcacgacggatgtcagcggtgtaggcacggaagataccgtcgtttacagttgtagcgtgttttgtatagatttcatgaaggagtgggtctggagtatagccgttttcgataagagttgtttcagccatacgaataccaccacgtggcatgaaattgagtttgaagagctcatcgttttggataccgaagatgagttcgttctctttatcgatgaaacctgctggaatatcagcgatagaagtagcacgatctacgtccattgggaagcgagtgtcttcgtagccagcttttgtttcttcgatgatttttttgatatgaagtgaacgctcagttgggcctgcgaggaagctttcatctccatcgtatggagtgtagttggcttgaacgaagtgtgttacacttgccttatcttgccaatctgtacctttaaagccttcccaggcttgggcgaaaatgtcttcagcaacattttttgttttaacttttgttgacatgagggttctccttttatgcttttgggtatcgacttgctatcgataccaacatgtcattattataccatttgaaaacactttctacaagacaaaaatacttgaaaataaatgaaaaacctttcaaggaatatgaaaaaaattgaaatatagagttggtattttcaaaataaatttctgcttgtatttgtaataaggtgataagctgtcgtttattgtattggtaagatggctggttcaacgaatctaaaggctgaaacttcctaagaaatgcggtataatatagcgagttaaacttgtaaacaggaagaggcagtcatgttaatttttcccttaatcaatgatttatctagaaaaattattcatgtagatatggatgctttttttgctgccattgaggtcagggatagccctgctttgaagggcaaacctgttatcattggggctgacccaagactatctggcggtagaggagtggtgtctacctgtaattatgaggcgcgtgcctttgggattcactcggctatgtcctcaaaagaggcttatgagcgttgtcctcaggcgattttcatttctggcaattatgaaaaatatcaggaagttgggcgacaggttcgagaaattttccatcgctatactgatttggtggagcccatgtctatcgatgaggcttacttggatgtaacagaaaataagttgggcatcagctctgcggttaagattgccaagcttatccaatacgatatttggaatgaattgcatctgacagcttccgcaggtgtttcctataataaatttttggcaaaaattgcctctgatatggaaaaaccgcacggtttgaccttgattctacctgaagatgctgttggtattctcgcctccctgcctgttgaaaaatttcacggtgtggggaagaagacggtggaacgcctgcatgagatgggggtctacacggggcaagatttgctagatgtaccagaaatggttttgatagatagatttgggcgttttggcttcgacctttatcggaaagcgagggggatttctaattcgcccgttaaagtggaccgtgttcgtaagtcaagtggaaaggaaagaacctatcgcaaacttctttatcgggaggaggatgtcctgaaagagctaatcagtctctgccaacgggtcgcagccagtttgaagcgaaatggaaaaaagggtcgaacaattgttttaaaggttcgttatggtgatttttctaccttgacgaaacgtcatagtctagaggtatatacggaccagacggaaacgattgagaaagaggttcgtcaactaattgaagaaattgggaagattgaaaaagggattcgtttgctgggtgtgaccgtgactaattttcaaacttgagttctgtttcagtctatgatagactgaaaaaaaggagaagagatgcaaatttcaagtagatttaccattgccagccatatcttggttctcttggctctggaaggagaaaaagaaaaacagaccagtactagcattgcaggcagtgtcggggttaatcctgtcattatccgaaatattttgtcccaactcaaggaggctggtctggtagaagtagcgcgtggtattggaggtgctcgcttggcacagggtccagaccagattacacttttgcatgtctatcaggctgtggagttatttggagaaaaaggtcaattattcgcttttcatgagcaaccgaatccttcctgtcaagtaggtcgcaatattcatcctctgctagatagccgtttggaaaatgctcagtcagctttggaaaatgaacttgctaagacaaggcttgctgatctcttggcggaactatagtcgttttattaggtcaacgtaaggagaaactttgtttccctatttcctacttcaaacactccactggactgttgaagtaatctgtagagtgttgccctagcactaaaagactggttagtgaatcatccttgtgatgattttttaaatttttgagttgtaacaattgactttacaatcaaaaagatttatacttacgttgtaaataaagttgttacaacaaaacaagtgaggtatcaatatgaaaattgctattattgcagcgaatggtcaagcaggtcaaactattgcaaaggaagcagtagaacgtggtcatcaggtgacggctattgtccgttctgaaaacaagagcgtagcccaagaagtaatccagaaggatgcttttgctcttaccaaagaagatttggcaggctttgatgtagtagttaatgcttttggtgcttggacaccagaaaccttgccggatcacgcccgtcttgctgagcatctagcgaccatacttgctggtagtccaactcgtcttttagtagttggtggtgcaggcagtctttatttagacgagagccagacagctatgctgaaagatacaccagatttccctgcggaatacctgccaatcgctgaggctatgggtactggtctagacctctatcgtcaggcgacagcggtcaactggacctatatcagcccagcagcagattttgatgcagaaggtcaaaaatcaggtgcctacactttggctggcgaggttttccaagtcaatgcccaaggtgaaagctatattagttatgccgactatgctgtggctttggttgacattgcggaaaaaggtggctaccagcaggaacgaatttccgtacttgcataaaaaattaaatggtctaaaagatagctccatcgaggaattatctttttattttttacttgcatatagtataataatataaataaaaagaaaaggagaaccccatgattcacttgatttgtcccaatccagccctagaccgcacgcttcttgtggaaaagattgaaaagaatattcccctgagaccgacggaagtgagggattatcctggtggaaaaagtttcaacgtagcctatgcacttcgagaaaatggagtgacagactacactatccataccattttaggtgggcagattggtcgctatattcaggagcttaatgctgatggtggaaatgccctgcgcgtggttgaaaatagccagaatactcggacatgtaatatctatgttgaaaccagtacaggcgatgtagtactattttatgaaaaaggttttgaactaacagaggatttgctcaaccaattcactcagcagattgaaaatagcctgcaagctggcgacatcctagtcttttcaggtagtctgatgaaggggatgtcggatgattatattcagcggtttattgaaaaatacccagaggttctgaccatagtggacaccagtggaccagctttacgtgcggcttatcaagctagaccggcccttatcaaaatcaataatgaagagctgaaagatatttatccagagctggatgaagaaagtcctgaagctattttaggtatcctgaaagaagtgactcctcatgagaatatcatcattaccatgggagacaaggggagtctagctaagattggtcagcgcttcttccgtattcagtctccaaagaaagaaacgcgtaatcctattgccgcaggggatttctacctgggcttgctagtcaaaggaatcagtcaaggtcaagccccagaaatctttttgaaagaagcggcagcctttgcaacagccaattgtttgaattattttccagaggttgaagcagagcagtttgaagcgattgtagatacaatagtactagaggaactgtagtattgtatccctttactcatcgtgctataatggcaaggagaaacaaggtgagatgggggatagtagtggaacagttgacggttctttaccaaaatttaaaacggcgatatggtgaatttcactggtggaatgatgaaaatcctataaaggatttggtatctatgatccttattcagcaaacaacggaagcaaatgccaagcgtgctttagaacagttggagggacggttgacaattcattcgcttttagagatgcctgtggaggatttacaagaatgcattcgcccagcaggattcttcaagcaaaaatcactctacattcggtcagtggttgagtgggccaatcagttcgatggagatttttctcgcctagatcgtgttgagacagcagtactccgaaaagagctgctgagcttgaagggggttggcaatgaaactgcggatgttattttgctctatttgtgtcgaagaagtgtttttgtggcggatcaatatgctcttcggctatttaatcgtttaggacttagccagtctcaggattatttgagtttgagacaggaatttacagagcagataaaagattggtcggtaaaagacgctcaggagcttcatgcactgattgatgaacatggcaagcagttcaggttaacaaaggggcagcttgatgaatcatggttgatgatatagtcatactcttcgaaaatcaaaatcagacgttgttgacatgatttgatgaacctcagttctatctgcatttgcatcgcctagcttgattttgattttcattgagtatcaattagtgtattttttattactgaagggcgaggaagtctcatttccttatttccgagtttaaacactccactggacagttgaagtagcctgcatatcgttgccttgtactaaaagcaaacgaaacgactataaaagagtaaaaccagcggttcagttggttgctctttttttatattaattggagttattttccaagataaaatgattatagactgctaaggatgctgctccaattgcacctcgaaatatattaaaagataagaattcaatatctaaattatttttacttggaataaattgcaattgattgtcaacaagattattaactttttctgaaaaacctggataatttaataactggctattaataaaaattttttttgaatcataaatgatcaatgtatttgcgattgaggtagttaaaaaatcaatccctgattcaattttttcaataataaaaccatctcctagtcggtatgcattgtatacaacatctaatgtaatatcttctggtttttcaaccaaagtttttatgatagaaccttgaacattctcaaataaaaatcttgcattattgattaaccaagtatcagaaatataagtttgaaggcatccacgttttccacattcacaagaaggtccgtttaaatcaactactgtatgaccaatctctccaatataaaagtttttgttttgtaaaatatgttcactatcaaaaaatgaacagaacaatccaggtccaatatgaataaataaaaactgctctggcgaactttcgggatgaaagagatatgaaccaattgccatgcaattaatattgttctctagaaaaataggaattgaaatactttgtttaattacggcaagatcaaaataaatccactttacattatttgaaataatatgtcctgattttgaatcaaagtgaccaggtacagcaataccgagagctccaaattcaagataggaaaacttatctagagtttcagttactaattggataattatttcatttatttgtttggaatcatattctgtaatttttatattgctatttgtgattaggtttccaatagtgtctgtgacggctaaatagattccattggcattaatctcgattccaatataatgtctatattgagagtttactgtaataagtcgtctactacgacctgatccaatataatctcgaacctcatcgccagtctcaataacttttttttcagctaccaggtaactaatcatattcgtaatagttgccggtgtaatttttaaagatttagaaattcttgttctagagcttttttgatgtctaaataaagtttttaatatatttccagaaatatttcgaatggtttcttctttttttcccattttagtacctcacattggaaaatagtatttttcaatgtaagaataacatattttttataaaaaatgaagtaaaaacactaaacaaataaataaatttcattttttaattaaaatttataaataaaaacttgacaattaagcgcttacatgatatctttaatttacaaaataaaattaatggaggataagaaaatgaatggattaatgcattttcttgaacataaactagctccttttggaactaaggtagggaatcaacgtcatttgaaagcagttcgtgacggttttatgatggctatgcctcttgtattagttggctcgttcttcctattgctaatcagttggccggatcaggcttctgggggattttcagtagtaggctttttagagcaaattggtttgttggggattttaaatcggttaaatcaatcaacaatggcgattatctctctcatagctacattcggtattgcatatcgattatccgaatcatatgagacagatggaccttctgcaggtgttattgctttatcatcttttattttacttgcgccaagattctcaacaatggttttcaacgaatctggtgaacaaattaatcaagtatttgctggagcaattccatttggaagtttgaacgcaagtgcattatttgttgctattgctgttggattagtttcagctgaaatttatcgtttctttatccaaagaggtattacaattaaaatgccaaaaaatgtcccagacgttgtgggtaagtcatttgccgcattgcttccagcattaacaacattaattttctgggcttgcgtcttccagggattagaagctgctggtgttgaaggtggacttggagcggttttgggattaattgtaggtaaaccacttggtcttattgcaggaagtctcggtggaatggtgcttgttgtgcttgtaaattcacttttctggtttactggtgttaatggtggacaagtgttaaatgcttttgtcgatccggtttggttacagtttacagaagcaaatcaacttgcagccgccgcgggagaaaaattaccacatattattactttgcctttcaaagatttgttcgtatttatgggcggtggtggcgctactgtaggattagcgctttgcttacttgtctttagtaaaagtcgtacatttaagagtttaggacgaatctcctttattccttctctctttaatattaatacagccattctgtttagttttccaactgttttgaatcctattatgatgattccgttcattctaacaccgacagttaatgcaataattacctattttgctatggcaactggattagttccgatgactactggggttgttctcccttggacgatgcctccaattcttggggggttccttgctactggcggcagtattcagggagcaattttacaaattattttaataggtgtctcattcattatttattatccatttttcaaagtggccgataataagaatttagagcttgaagaatcaggagagtgatcatatgaaattgacgatttttgataaagtacagaataagacttctcaatttgctatagatgaacttacatattacttgaaagccatttttgattttgagttaggaaagacaactgttgaggaagatgcgaatgttcttttgtcaaaagaatatcttgacaataatgatacgattgggattgaaatgaaaaatggaaatgcaatattaacaggtaattctgatgtctcaatccttattgcggtatatcgtttacttagtgaatttggagctgtattcactagaccgggtagaaaacatgaattaatcccctcattaacgataactgactggaatgagaaagagctttctattcatgagactgcaagttataagcatcgaggagtatgtatagaaggtgcagatagttaccagaatacaaaagaatttttggattggttacccaaaattaatatgaatagcttttttattcagtttgagaatccttattcatttttaaagcgctggtatgaacatgaatttaatccgtatgcggataaagaagatttcaatacggaaattgcacaacaaatgagcgaccttttagatgaagaattatcaaaacgaggtttaatacatcatcgtgttggccatggttggactggtgaagtacttggatattcatctaagtacggatgggaatctgggttaaaactacctgaagaaaagaaaccgctagtcgccgaattaaatggaaaacgtgagttattcaacacagcgccaatactaactagtctatgtttctccaatccagatgttggtgaaagaatgtgtgaactgattgtaaattatgctaaggaaaggaaagatgtagactatttacatgtttggttatccgatgcacggaacaatatttgtgaatgtgaaaaatgtaaacaagaaataccctcagatcaatatgtacgaatattaaatcaattagatcggaaattaagtgaagaggggcttaatacaaagatttgttttttactttatcatgaattactttttgcaccaaaacatgaagttttagagaatcctgaacggttcactatgatgtttgcaccaattaccagaactttcgaaatgagttatgcagatgtagactatgaaaacgatgttccgcttccaaatgagtattcaagaaataatattgttcttcctaactcacttgaagaaaatctctcatatttatttagttggcaaaaagtgtttaatggagatagttttgtatatgattacccacttggtcgggcacattatggtgatttaggatatatgaagatcagtaaagtaatctttagagatgtcgtatatcttaaaaaattgggtttaaatggttatattagttgccaggagctacgcgctggtttccctcataactttcccaactttgtgatgggtcaaatgttgtggaacagaaatttagagtacgatgaattgaaagcgctctattttagttccttatatggttctgaatggaaaagtgtcgtaacttacttagaaaaattatcagattactcttcatgtgattattttaattcaataggtgatcgccaaaatgcagaattatcaatgaaatacaatatctcaagtaaattagcatttaattttattaataccttggaagagaatgttgctaaaaataacggaattcaacgtgatgcttggcgacaattaggttatcaccgggaatatgttgtcaaattggctaatgcccttcatcttatggcctctggagaccatcttgatggacaaatccgctggaaagattttttggattatattagaaaccatgaacctgattttcaacagtatcttgatgtctatcgtattattgaagttgctaagaattatgctggattcaaattgtagtactgagttgtagaaaaaagccaattcacaatttattttgcgaattggcttgaagtctaatatagatagaatattgaatttatttgatgttaattgatatttatttttgagaggattttatgaataaaaaaatttttttaaaatcagcgattattttgctctctgtcacatgtctaattaatgcgattaaagctttagatagtagtggtgtgtcatcgagtacaggtgaaatagtaaatcaagatcgcatatacaacataactttgaaagtgaaaacagatggggtttataatgatctgggggggaatgttatttcggaaaataatgtattgtcaggaattagtggtacaaaaataaatttgaaggttagtacaaattcaggatatcgttttgtagggtatcagtcatttttagaaagtggaaatagtacagatgggttactaccaatcgaaaatgatagttttgaaatctcggataaaacgggtaatgtaacggttgttgcgatgtttgagaagattcctattgatgagacaatttatttttcggatgaattctcaactgaaaatattaataattacttgttatctgaaaatctaattggaaaaattgcggtaagtaatggaaaattgaacattcatgctcccggggtatcatcgataaaaccaattctttcaagacagattgatgaaagttcaacattggggtatgaaattcaattttccatacaacaaattggtgaagtaaagcagtggaatacttttagagtagtatttaaagaaaatagcgatggatcagtttatgctctagaatttactggaaaagctgtatctataaaaaaactttcaagtattgatgcacctaatcaaactggtgaaaaatacgctgaaacaggccacaatctaggaagtgaagaacacagaataagacttgtagtaagaggggatacagtaactgttagtgataatgaaattccgttattaagttatagcagtcctgaaaattgggaaggtgcaacagcatccattgtttttacaccgatttcaaatagaagtgtatctttagacgatatcattattcgacaaacacgtgctttaagatctttactagttgtgtctcgtatagatggtcaggaagttacagatattcaacccggatcaatcagagggaatacaagtcaagtttttgttggagattcacttcctctggaggtcattgaaaaacctggatatcaatttattggttttaaagatgaatttggaaatgtggtcgatttatctactttcagtgttcctaatgatgagtcggatttggttatttatgcagactttcagacagctgaagtagtgaatcgtgagacaaagactttttatattgatagtatagaaggaaatgatactaatagtggagaaagtgagactaatgcatggaaaacactcgaacaattgcggaaaaacacactaattgctggtgatagagtgctattaaaacgtggaagtcgttttgttggagaagatgcggcattaacttttaaaggttcaggtcttgaagatgcgcctatcctaatttcatcttatggtgagggagagctgcctttgcttgaagcacagggcaaaattgaaagtgtaattaagttatataatcaagaatatattacaattgaaaatctagagattacaaacttagatccgaacttttcaacgagttttgaattaaattcaaataataaccgttcaaaaatactaagaggtgttcatgttatagctgaagattatggggtagttcatgatatcgttcttcgaaatatgtatctacatgatattaatggtaatttgaattcaaaatggaatggaggtattttctttgatgtttatggaacaacagttccaaccaaatatgatggcatacttattgaaaataattatttagaaagagttgataggtcagggattaaattggtcgggtccacatgggcaaaccaaaatctaaaaaacaacaaaaacattccattaaattggtatccatcaacaaacgtagttgttcgtggcaatcgtatcgaaaaggctggtggtgattctataacagttagagatacagatggtgctttaattgaatacaatatctcggctgatgccagataccaagatacaggttataacgctggaatttggccatttcaagcttcaaatactgttattcaatataatgaatcatttagaacccatggtgttcaggatgggcaaggtttagatctagaccatgtttcaaataattcagtaatgcaatataattacagtcatgataatgaaggtggtttcatgttgattatgaattggtacgagcaaacatctccaacagtccgttataatattagtcagaatgataaagataaaatttttgaattggctagagggggagcccaaggaactgctatatataataataccatcttctccgactcgaaattaacagggagagctggcgttattgatatgccgagtacctcaggaggaactggtgtaaaagatatctttttatttaacaatattttttactttactgatggcgaaaaaatgtttgtagaagcaagcgatgctggtaaatataaagatagtattcatttttataacaatgcatatgtcggagttgaagtgccagatgatcccaaagcgataactgaaggtataactttaaaaggtgttggaactggaccgactgaaaataaatcgatgattgcaaatgctgggaaatttttaacaggacaattagatgggtatagattgcctgaaaatagttcgttagctaagcttggtgtgagcaaagaggaagcaatttcttatttctataaaaaactaggtgtgcagcccacaattgatttccaagataatggctccttaactatgtctccgacagaagcttttgccttggctcgtcaaacaaacagtgttgacgcgattgcacgtgtttatcctgcaatagaaggggttacttatgatactgatttctttggagaaactttgtcgagtgaaaatttatctgttggtgcagctcaagagaaaaaatcagtttttgaagaaaaaatctctgatatagaaatttcagatgtgaaaacagggattggaatgagatataaacgttcaaatcagcttgcagatgtaaatttaagtataagattgataaataaagatgaacttcaatatactataaatgctaataatccaactttttcatatgaaattcaacttcaaaaaaattttggagagtatatggatttaagtgagagtgtgacaatcaccattccaattgaggcggataaaaagattcttaatgttttgaaaattaataaaaatgaacaaactgaatcagtgaaagaactgccatatcgaattgaaaataataaaataatattagaaaccgatgagcttggttcatttatcattgaataccagatggaaaaaattaaaaaagaaaataacacaaatgcaacaataagtgaaagtggaaaaagtagtttagggttgcaaaataaagaaaattcagatgtgcaagctgtaggcgataaagattatttttctggtcttgaactatcaaataaaggtgaagagttaagtcgtgaagattctaaactaatggggaattcaattaataatttacaaacaataaaagagtctgaaagtattttcgaaggaaatttgggtaggaataaagagttgagtgacatgtatcaaaagtcattgccaaaaacaggagaaagtaaccaagcatatattgttttgattggtttatttagcctcttcgtagtcctaatttgtcaaatttttaaaaaatcaatagattaagggatttaggataacaaaatgacgaaaaaaataatatttatcttgttattcttcgtagtttgtgtttatttctactcctttattcccctcgttcagactgttccatctgtttttcagacaccttatagaacattagttcaatctgagtttgaagcgatatataaatataatggtattgaaatttcggaaaggaatttttggaataaaccgataaatggtcgtaaaccacaagatactctgaatgaaaaagcaacgatattatttaaaaaatataatcttttagaaaaagaagcgaaaaaacatgaatataaaaaagaggctcttgatttcaataaagttgattggaagacagtctcaaatcgctatattgaattaaaacaaattgttattgatgaaaaaattaaagatataaatcaagatgagattgaacgatattacttagcaaatactgaaaattttgaacgtcaagattttataagcggtaacatttctatatggaatgatgggataattatttctactgaatcagtagatattaccgaggaaacagtaagaaatataactgaaagataccctgatttagaattagaattaaagaatattgaagttggtcatcaagtttcttggggacagaatggggtttattatacctttacatgtttgtcgagagaagaaaagggaattattccactttctgaaatcacggatgcggttgctatgcaatgtgcagaggaacttgttgataattggttaaataaagaaattgactctttaaaataatccttgattattgacaatctagagttaacaaaaattttttgttaatttaaaaggaattgggaattgtcgtactgaaaaactgatttcaattattaagttaagtttcttagttaaatactgtaatttttgtagccatactaatatatattttgtaaaatagagttacataaatttattaagacgaaacattttttatgtatttgtaactatgggaggatgaagatgaagagcaacaaagaacaaaaatatttttggttgacattctcattgattgttgcattgatgatttggtggtttttatcgaattatgatcgaacctctcgtagttttccaaatatcattttggtttggaatgctttattaatcatgatagacaaaggatttatctttgaagatatattttcaagtctaacttcagttttcttcgggttcacgtcgggctttctattgtcggcgcctaatgcactcttaatggcctggtattcaccttatcgtaatattgtgaaaccttggatacaatttatcagaaatattccacctcttgcatacgtccctttagttgtaatttcagctggggttgggctattacctcaagttattgtaatagcgatagctacttttctgactatgactgtaacaatttatcaaggcattattaatatcgatccaaatttaattaaagcagcaaggattttaggagcatcagattttgaaatatttaaaagaattttggttccctcatctattccatttattatgacagctgtcagattaggtacatcgatttctttaacaactatcatagcagctgaatctactggtgcaacatcaggtatgggaatgagaatacggtccttaaataactcttttgattcctcgggaatgcttttgtatatcatattgattggagtgattggtttacttttaaataagttagttgatttgatagaaaggaagttaactggatggcaacagaagtaaaaaaaattaaggtcaaaattgaagatgtttcaaaatcatttcagacaaatcatggtgaggttgttgcactaaatcaaataaatttagaaatctttgagaatgaaatagttacagttgttggtccatctggttgtggtaaatctactctactaaacttggttgcaggtttggaacctgtaacttccggaaaaatttattgtgatgataatgaaattgttggcattggagttgagcgtggagttgtttttcaacaatatgcattatttccttggatgagtgtactacagaatgtaatgttcggacctgaaatgcaaggaaaatcaaagttagaagctagtgaaatagctaacaagtatattaaaatggttggattacaagaattttccaatcattatccgaaagaattatcgggtggaatgaagcaaagggttgctatagcgagagcttatgctgttaacccgtcaattctattaatggatgagccctttggagcattagatgcactaactagaattcagcttcaagaggagttgattgaaatgttaggacaagaacaaaaaacttgttttttcataacacatgatattgaagaggcggtactattaggaaatcgagtgattgttatgagtccacgccctggagaaattaaagaaattgtgaacgttgatttaccatttccaagaaatcagttgacaaagtttgaaaaaaattttatggacataaagaaccatatatggtcacttgtttataaagattttctaatataaaaaagtgaaacagtagaattattttgtgagagggtaaaatggctaaatatatgaaatataaaaacttcatttggtttatttgcagcataatcactctgatttttctttcttcgtgtagttctattcaaacctcctctagtggccattcagcaaaagttgacacaattagaattgcatatatgccaaattttgcaagtcttcatgacattataactggaataaattcaggtatctttaaagaggaggggcttgaagtcgaattgattgaatttgctgatggtccgactatcattgcatctttagagtcaggttcaattgatattggtaatattggtccgggtgcccataaattggcgattgaaggtagagcagaagttgttgcatttagtcaacttgggaatgctgacgaattgattgctcggtcggatagaggaattgattcaatagaggatttgagaggaaagaaaattggaacagcatctgggacatcagcagaaacaattctaaagcttgctttgttagaagcagatttgtctgaaaaggatgtagaaattattgatatggatgcctccgctattgttacagcaatgttgtcgggttcaattgatgtagctgcaacctggtcaccaaatacaacttttataaagcgagaattaaaggaaaaggtcgttgtactagctgataattcacgttatagagaacaatctccagctattgcttcatacgtaacttttccggggtattctgaaaaaaataatgaaaaaatttccaagtttttaaaagggttatatcgtgcaatggattatcgagctgaacatatgaaggaagtttcaaaatgggttgctacccaaatcggttcagatatcacagctgttcaagatcaactacaagatggagagtggttaacaagtagacaaatgattcaattgattaacactgggatacttcaacagtattacgagaaacaacaaaaaaatttaatagaatctgaaatagttgatacatccaggaacattaatgaatatgttctaattgatcaaatgaatagtatattaatggagattaaataattcttgtgaaacacaattagccattttattttcaataaaagttacattgaatcaataatcattcatagttttcaaggaaacatgaggtaatgcatgatagaatattacaattttagtaaaagtgaattagaaaaccatagtagaattccattgattataaaaaagaataatgaggaaatttttatttcacttgctctagaaatggtagaattaataaaagaaaataacaaaaaaaatgagaaaactgtcataatttgtcctgttggaccagttggtcattatccccattttgttagattagtgaatcaatttaagattgatttgtctgatgtttggtttataaacatggatgaatatttatcggaagatttacattggatagacgtagtccaccctcttagttttcgaggatttatgcagaaaactgtctacagtcaaatacatccaactcttattatgcctgaagaacaaagaatttttccagatcctcttgatattgacttgatttcaaataaaatcaaagagttaggtaaaatcgacttatgtattggtggaattggcctaaatgggcacattgcatttaatgaaccggattcaacattaacagttcaagaatttttaaaattagagtcgcgagtgttacctatctctgtcgaaacaaaggttatgaattgtttgacggaattaaaaggggctgtagaagaagtgcctaattattgtgtaacaataggaatgagcgagatttttcaagcgaaaaaaattcgacttgctgtttttcgtgattggcatcatgcggtcatacgtaaaacagtttgttctaagccagatactggatttccatcaactctaatgcaaatccatacaaattgttctatctatctaaatgaatcgttagcaaattaacggatgttcaaacacatatgaaacatatataagtctgttacccttttgatcagatacctaatgagagaggattctctcatttttttaatcaaaatcgtttacaaatgtaatcaaaaagcatgtgatttgactgcaaatgtagtcaaaaggagagcagtattatgaaaacatccatctataatgtcaatgggatgacttgcgcaacctgtgctctgacagtcgagaaagccttgaataagctagatggaatacaaaacgccagtgtgaatctagcaacggaaaaaacaaacattcagtatgatccagcccatctgagcttatcagatatcgacagctgttgaaaaagcaggttataaagcggtactgccaaaaacacaagagtcagaagctcaaccaagcggaaaagaacaacacaaaaatgatttatggcgcagatttatctggtcaaccattttcacgcttccactactctacattgcaatgggacctatgttaccaggtgggggattgccattgccagctatcttacaccagccgctagtttttgccctagttcagctcattcttgtattaccagtcctatatgttggtcgtgcattttatcaaaaagggtttaaaaccctgtttgccggtcatcccaatatggatagtttgattgccgttgggacaagtgctgccttgtttcaagggatcattatgacgattttgattgctaccaaccaagtagccacccaacatggacatcctgagctctattttgaatcggcagctgttattttaacccttatcactcttggaaaatacatggaggcattatcaaaagagcgtacttcagaagccatcagtaaactgatgaatctcgcccctaaaactgcacgcgttctctgtgaaggtcaagaagtgaccctccccttagaccaagtcaaagtaggagatgtccttcaagtccgccctggtgaacagattccagttgatgggataatagtagaaggccaatcgacaattgatgaatccatgctgacaggggaaagtttgcctgttaaaaaaacatcggggatacagtcgttggtgcgactctcaatcaacatggtgctttccaaatggaagcgacaaaagttggagcagataccacattgtcccaaattattcgtttggtggaagaagcacaggggtcaaaagctccgattgcgcagttggctgaccgcgtttcagcagtctttgttccaattgtaatgggattagccgtcctttctggccttgcttggtacttcttgggacaagagccctagatgttctcactttccattaccatctccgtccttgtcattgcctgcccgtgtgtcttgggccttgccacaccaaccgctatcatggttgggactggaaaaggggcagaaaatggtcttttgttcaagtctggtcaaactattaaaaccctacaaggtgtgaacaccattgtcttcgacaagactgggaccattactgagggcaagccacaagtgacagacatccaccttttgtctactaaaaatcgtgagcaagttctccaactggcagcaagcagtgaacaatactccgagcatccattggctcaagccctcttacgttcagcagaagaggaatcaattcccttacttgccagccaagattttcaggcactttctggtcgtggtctttcggtaacaatagcagagcagaccatctatctgggaaatgaacggttgatgcgggaacagggaattgatgtttccaaaggacgtgcagttgcggaaacatttgcccatcaagctaagacgcctgttttcctagccagccagcaagaattactagcagtcattgccattgctgataaagtaaaagagaccagccgtcaggctgtccaggctctgcaaaccatggaactagaggttgtcatgctgacaggagataatgaaaaaactgcccaggctattgccaaggaagtcggcattgagcaggtggtcagtcaggtcctgccagatgacaaggccaaccaagtcaagttcttacaagaacagggcaagacagtcgccatggtaggggatggcatcaccctgtctgattactatgaccatgcctttggaaaatcctacggtgtgctcatgcgggagtggaatttgctggcgcgtgcggtctttgtccttaatgccgacaatgagatcgtctacgtagaatacctagacaatgtcaacgaacacccagattataaagcagctttagaggctgtcaaataaaagaatataacggtgttcatctactgacttgctggtttttatgctttaaaaaattcttcaatatctgcctgttctatgccaatcatggggtcgatggttagtaggttgtctacagtcaaaatgtattctgtgggttggggacttgttttttctggctggtcttgatcaagaagggagagttgttggttgttttctttgactactttaacctgttcttttctgtctggctgagtagggggctgggtttgcgtggttgtagctgttttgctttcgtcttttttaatcaggctttccttgctttcctgctctgccatttccccttggaaacgtgggaccagataggtttttcggacggtgccggcgtttttgacggcgtagtcgaaggcggagatttcgcccaggaggatgagcttgctcttggagcgggtgatggcggtgtagaccagattgcgctggagcatacggtggctggtgcgggtgatggggaggatgactacctgaaactcgctgccttgggacttgtggatggacatggcataggccagggtaatcttgtaccattcgtttcggggataggtgacctcgctaccgtcgaagttgatggtaatttcgtcctgcttggagtcggtgtacttggcaggaaggaggtcggtgatgtagcctaaatcaccattgaagacattggcctcggcatcgttgactaaatgaatgacccggtcgccttggcggaaggcttgctcgttatgcaggaattctaactctccctcttccagtggattgagcagggcctgggtcatagtgttgagttggtcgatgcctgcggccccacggtacatgggagcgaggatctgtacctcgtttgcaggaatacctgacttgatggctgcgccgacaatgcgctcaatcagggctggaatttgttcattctgggcttcaaaataggaacggtcagcctttttctcacgaaaatcgctaggcagagcaccctgtcgaatctggctggctagggtaacaatggtcgaatcatcggattgacgatagatacgttctagagtaatgctgggcagcttgtcaattttcaagaggtcagcaagtacttgaccggggctgacagaaggcaattgctcggcatcgccgacaatcagaacttgggtctgggaggagatattctggaagagctggtttgccaaccaagtatctaccatagaaaactcatccacgatgataaagtcggcatccaaataatcatcacggtaggattcctcctgtccttctaccagaccgagatggcggtggatggtggcggaaggcagccctgtcaattcattcatccgtctggttgctcgtccagttggagcggctaggaggactgggcattcttctcggtttcgcgtcaggtcaatcttatgcaagatagcatagactgcgataatgccgttgataaccgttgtttttccagtccctggcccgcctgtcagaatgaaaagcggattggtaatggcttggacaatggcttctttttgaatgttatcgtaggtgagagaagatatgctttccagctctgctatggcagcctcgacgtctgcgcgtgggaagggcttgaagccgttttttcccatcaggcgagttaggtttgtatggataccatgttcggcaaagtagaggctgttgtcaaaaatctttgtgccttcttgctgtaccttgtcgtctgcaatcagtcccgtcaattctttggcaacagcagcggggtccagctctgtatggcgggatttttccagcagttcaagggttgcttccagcaagtctctggcctccacataggtatcgcctgtttccatggagcgatgaatgagactaaagagcatgccagcccgaaaacgttggggtgaatcactggcaattcctagattttccgcaatcctatcggcaatggtaaagccgagcccctggacatcttcgaccagttgatagggattttcttcaataatctgaagtgttttttccttatactggtcttggatttgaaaggccaatttattgggaatgccatactcggctagttttgccaagatcaactcggttccataattgaggcggagtttttcgacaaatgcctgcatgttcttgctggataggcctgtgatttgggttagtttttcaggttcagctaaaatcttatcaatggtatcttcgccatagagctcaacgattttttcagctgttttgcgtccaattcccttgaaatgctcgctggagaaatacttgaccagaccagctgaggtaggcttgctgcgttcgtaacgcgaaatttgcagctgctgaccatacttgggatgggtgaccagattgccatagaaacgatagtcttctccttcaatgacatcggcaatcgttccggtcacaataatttcgtagtcatcatagtctgcgtctgtctcctcgatttcaaggagaaggattttataaaaattactaggattttcaaaaataatccggtcaatagtaccggtaaaatacacttcgttcatagagtttatttccaataataatgaaaagggagtggggaagaactcgcatagaccaaaaagagttcccctcacttccaaatatgcaggttcgggctaaaatagtccactggactattttactcccaacccgcacagctccaacagtccagtggactgttaaacccaatcaaccactgcgctgggatgttgacacgaactctgagaagtggtgctgtgctttttgctccaaacttgtttgtattaatcaacagtcccaatacggttgagaggccacatgcgaaagacaacttctcctttgatgttttcacgggaaaatgttcctacactacgactatctagtgagacaaggcggtcatctcccatcaggtagtattgtccttctgggactgtcacggtaaagtctacgtaaccattggcatcttgtgtgaaagcttcagcagattgggccacagcttggaattgtttgttataagaatagacttcttgaagtttatctttttggaatgcagctagatattcatctaagtaaggctcgtccactttttggtcgttaacatagaggacatcgttttcgtagcgaatggtgtcacctggcataccaatcacacgtttgacaatcagtttttccttgccatcgctgtctgtttcgctggctacaacaatatcaaagcggtcgatagaggatgttttgagcatgatgagtttttcttggtgttgaagcgttgggtccatggaatggccatcgacagatacaggattccagataaagtaacgactggcaaaaaaagctgccataaacagtaaaaagatgccccattcagctaagaaggcgactagtggtgagcgttttgttttttggattgctcccatattttttcctcatttcaataatttttgtgctttttgcgtattggcaaagtggagtttggcagtttggttgagaccagccataccatattgttttaagatgcttgctgcgacttggtcggatttactgcccgcaccagacggcagatgcattccaactagttgaccaagctggacaagattttctaaaaacatacttcttgcaatgatagaagatactgccacagccagatacctgccctcagccttttcttctagagtgacggggttggcaaattggttggcttccttcttcaagtacttttgataattttgactggaagtgaaggcgtcaatgacaatcttctcaggctggacacccttttgcaagagtaggaaaatagcctgattgtgtagggcgaccttgacagacaccgcattgtagccttgctcgatgacttcgttgtattttttcggtgacaatagcagagcttggtgggggattttctcttttaagagaggggcgatttggcagattttttggtctgtcatttttttggaatcatcgacaccaagcgacttgagaaaggaatggtcttctgggcggacaaaaccagcaacgactgccaaacctccaaaataagacccgtttccaacctcatcggtaccaatcatgggcaggttttgaccaggtatggtcgcctgtccagagctttctggctcatagccccaacggcttgcttcctgctctgccatttccccctgaaaaacgacttttccagaagtgtagatggacaggcttgcaccggtcagtttgaaaaatgcttctatgtaaggatttttgctggtctgccgatagcggtcatagtgagccatcatggcttgtttttgctgggcagatgcctttagtacaacggtattcatgttcttattgtaacacaaatgctagttagagtgtgcagaaaagggtggaatttactataatggtagaagaaagtgaggtacactatggaagtgcaaatgaagtataaatgggcgactctgggaacaggtgtcattgccaacgaattggttcaggccttgcaggctatgggaggaaatctttattcggtagccaaccgtacctatgacaagggtgtggaatttgcgcaaaaatatggcatcgagaaagtttatcgagaaatcgatgaagtgtttgaggatcctgaagtagacattatctatatttctacgcctcacaatacccatatcaattatttgagaaaggccttgaaggctggaaagcatgtcctctgtgaaaagtctattacgcttaattcagaagaattagcagaagctattcaattagctgaggaaaatcaggtcgtcttggcggaggccatgaccattttccacatgccaatctatcgtcagttgagcgaagtggttgccagtggcaagcttggagagttgaagatgattcagatgaactttggcagctacaaggaatatgacatgaccaaccgctttttcaataagaacttggccggcggtgccctcttggatattggtgtctacgctctgtcctttgtccgttggtttatgatagaaaagccaaatcaagtcctatctcaggtcaaattggctccgacaggtgtggacgagcaggtagggattttgctcagcaatgatgcaggagaaatggcgaccatcgccctgaccctccatgccaaacagccaaaacggggcactattgcctacgataaaggctacatcgagctttacgagtacccacgtggtcagaaagcagtcattacctatactgaagacggtagtcaagaagtaatcgaagcgggcgagacagccaaggctctttcttatgaagtggcggatatggaaaaagctgtcgcaggcatcgaaaacaccatgcacctagcctacacccaagatgtcatggagatcatgacccaactccgtaaagaatggggcttggtttatcctgaagaaatgtaggatcttgactaatccgaaaatagaaatgagagtgagttagtagccaattgttggattactgccttactcttattttttacttatagtcttcgaaaatccagacgttgttgacttgatttgatgaagttttgttctatctgcatctgcgtttccgagtctgtttttgattttcattgagtattacctaataatatgacagtcagatgacatttatattgattgtgtgacagaaaagtcctaagattacatagtggagacagtttatttaaaagaacggttgaaggcttgtttttcagatttaatttaggtaagatagaaccatctcaaaaataatgaaggaataagattatgaaacgtaagagaacaaataaaccacaacatatgcgtcgcaagagaaaaacatccatcatgaaaaacaataagaagatgttatacacatcttcattggctctttccctctttagtacggggatgatttcgacaaatgttttagctatcgaatgggctccacgtactgtttctgaaattagcccagaaattgtacaagaagaaggaatgatgacctatactgttcagtatggagataccttatctgccatcgcctcagctatgaatattgatatggacttgctggcgaaaataaatcaaattgcagatatcaacttgattttccctgatacagtactgacgacgactgttgaccaaaacaatcaagtgactcaggttgagattgaagctcctgttcagggaaacacaaatgagaccgttcaggcaactgttgacctaacaaccaatcaagtaacggttgaggatacggttgttcccttggatcaaatttcatcagttaccgactcagcgcctgtagaggaagttgtagaacagcctgtagcagaagcacctgtggttgaggcacctgtagaggaagttgtagagcagcctgtagttgaggcacctgtagaggaagttgtagaacagcctgtagttgaaactccacaagtgacagccctatcaaccactacaacaagtacaagtgcttatgatgtcggtttgcaacctcaggtagcagccttccgcgcagaagtagctaatgccttcggtattacttctttctcaggttaccgtcctggtgattctggcgaccatggtaagggattggcaattgactttatggtgcctgagagctcagctctaggagatcaagtggcggcttatgcagttgcaaacttagcttctaaaaatatcaactacatcatttggaaacagcgcttctatgcgccgtatgacagtatctatggtccagcctatacatggaacctgatgccagaccgtggtagcattacagaaaaccactacgatcatgtgcatgtatcttttaattagacttacaaaaataaccgtttcagccttatctgaaacggttattgctttatatgtagtaatatagtcgaatgaattaactttcagacaaggaactgaggtgcaggtagctagaacagcctagaggctgttctaggttggaaataagacttgcgaaacaagtcactttcgtagagtacggcaagccgaaagtgacgatgtatcaaagttaattcaaatgactataaaagaagaaacaactatctccccccagatagctgtttcgtgcgcaaattacagtctaaaatatattcctaaaagaaaccttaaaccaagaacttgccttcacaagtaacctactgagctgtgaaggcgggttctaattttaggaaaattaaaattgacatgtagagtgttattttcggatgttttatcgtttatttaacttgaatcgccaatgcttggtaaggtttgagaatgatttttttgcctagtttgttgtcaggatagttgctgatgaggacttggccgtgggcatagtcgtctgccaggtctaattcgacctcttctgcaaagaaattgttgaggaccaacagtttttcgtcatttagcaagcgttcaaaggcgtagactttctggctatccttgtaggctgccttgtagtccccttctgaaatcagagggagttctttccgcaggcggatgagttcttggtagaaggtaaagattgggcctgttttttcctgttcaacgttaatcgtttggtaggatttgccagctttcaaccaaggagtgcctgttgagaagcctgcattgtcagaagcgtcccattgcatcggggtgcgggaattgtcacgggacttggcctggataatcttgaaggcctgcttaggcgtgtgaccttggtccaagagcatctggtaggcattgatagactccacgtccacgtagtcgtccatgctatcgtagtcagggtcgatcataccgatctcctcacccatgtagatgtaaggtgtgccgcgtgataggtggatagaggctgccaacatggttgctccttccttgcggaaattctccacatcaacaaagcggtttagggcacgaggttggtcgtggttgttgtagaaaagggcgttccagccatttccgacggacatttcttcaccccaagtgtggaagaggtgtttgagttcttcaaagtcaaagtccatgatggtccatttttgcccgtccttgtaatccactttcaagtggtggaagttgaaggccatggacaattctttccgttcaggagctgtgtagaggatacagttttcaatggtggtggcagacatttccccaacggtcatgaagcccttttcactaccaaaagtagcattgttcatcatcttgaggtaatcgtgggtaatcgggcggtcggtgtaagctggcttgccgtcattaattgggcaatcttctaggacttcgtccttaccaatcaggttaataacgtcgaagcggaagcctttgacacccttgtctttccagaagttgaccaccttgaagagttcttcacggatatgaggatttcgccagttgaggtcggcttgggtcacgtcaaagaggtggaggtagtatttcccagtatctccaaaaggagcccaggcattgccaccaaacttggacacccagtcagttggctggtcacgcaggataaagaaatcttggtaatatttgtcgccggcaagggctttttggaaccattcgtggtcggttgagcagtgattgaggaccatgtctagcatgaattcgatgcctagttctttgccgacagtcaccatttcttcaaagtcagccatggtgccaaaatcaggattgacagctgtataatcagaaatatcatagccgttgtcccgctgaggacttgggtagaagggattgagccaaatcatatcaatacctagctcttttaaatatgggagtttttcaataattcctcgtaaatcccctacaccatttccagttgtatccttgtaagattttgggtagatttgataaacaacctttcgtttgtctattgtcattttgctctctctttcttgatttttccttcttgcataagcaatgataggaggtgcaagttaccttgcgccctcctagaacattaattctttgtaactgtcagaatagcttcgccttgtgagatggcacgaggaagatttccgataacttgagtgtcaaagtcagtttggttggtcacgataactggtgtttcagcgatgagaccagcagccttgatgacatcgatgtcaaagctaatcaatttatcaccagcttttaccttgtcgccttgtttgacgtgagctgtgaagcctttgccttccaatccaacagtatccataccaatgtgcataaggagctcaactccgtttgtagcagtgataccaacagcatggttagttgggaagaggacagatacttcaccatcgactggagcaaccaagataccttcgctcgggtcaataaggacaccttggcccatgacacctgatgcaaatacaggatcagtagcttgtgacaattctttggtttgaccagtaagtgggctaatcaattcgatagcagcgccagtttcaacaactgcttcagttggagctacaacttcttcaacagtttcttctttttttgaaaatgcacctgtacgtttgaaaacagctgtcaaaatcattgggacaacaatcgcaacaaccattgtcataaagaatgcaccccagtattcagccttgatagacaagatacctggaagaccaccgataccgatagaagctgcttggatgttgaaggttacagagagtaagcctgcgatacttgaaccaatcatagcagctacaaatgggtaaatgtattttacgttgacaccaaagagggctggttcagtaacaccaaggtaagcagaaattgttgcaggaagagaaacttgtgcctctttttcatttttacggttcatgaggaagtaagcaaatactgcagaaccttgtgcaatgttagaaagggcgatcattggccagagaccagtaccaccagcatccgcaatcaattgggtatcgatggcgttggtcatgtggtgaagaccagtgataacgaatggcgcataaagggcaccgaatacagcaccgaagagccatttcaatgggccagtcaaaccagctaatacaactgttgacaaccattgcccgattgtccaaccgataggaccaaggacagtgtgagccaagatgattgcaggaagaagtgataggaatggtacgaagatcattgagaccacttctggaacaaccttacgccagaagatttctaggtaagacagtgccaaaccggcaaggagggcagggataacttgcgcttgataaccgatacgggcaatactaaatgcaccgaagttccaagaccagtcgctggcaatggttgctgcatctgtaccaggtacagcataagcgttgagcaactgaggagaaaccaaacagataccaaggacgataccaaggatttgtgaagttcccattttacgagatacggaccaagtgatacctactggcaagaagtggaagatggcttcacctggcaaccagaggaagtgattgacaccattccagaaaggagaaacctgaacgatggtgttccatacagggttaccatcagcatcgaagaccaactgcccatctttcatagcttgtccaagccattccatctgaacaccttccaagacgttacggaaaccgagaatcaaaccgccgacgataagggcaggaatgatcggtgtgaagatttccgccagcatggtcatgacacgttggatggcattttggttacttttagcggctgactttgcagcttcttttgatacgccttcgataccagacacagctgtaaagtcattgtagaagattggtacatcgttaccgatgatgacttggaattgaccagcgttggtaaatgttccttttactgctggaatgtcttcgatgacttttacgtttgcttttttctcatctgcaagaacaaagcgcatgcgcgttgcacagtgtgttactgcattgacattctcttttccgccaatagcttctaggagctgtttggcttctttttcaaattttcccatatatttttccttctagacggcttatggaatccgtcaccctatattttttagacatctctcgaagcatgtccttttttgaaatttgtacggacaaatttcttttgtgttatcattgtatccgatttcaaaaaataatgcaagcgtttttgcttagttttttttaattttgaaatgaattttgttataatgttgatagttgtatgttatttgacagatgaatttgcgaggaaatgatgaaaaaataccaagaaatttataatgacttaaaagaaaaaatacggacaaatgtttatccggcagaaagctccctaccgacagaacagcagcttcaggaaatctatggtgttagtcgtgatacggttcgtaaggcgttggcgattttgactgagggaggtttgattcaaaaagtgcaagggcgtggttcaatggtccttaagcaagaaattctcaatttcccagtttcaggtttaacttcctatcaggaattgacaaatgttctccagctttctaccaagacagatgttgtcagcttagatatgattaccgttaatagtagcctttcgcacttgacaggctttgagccgtatagcaaggtgtggaaagttgtccgtacacgttcgattgacggtaaggtctccgttgtggatacagattatcttgctgtcgatgtcgtgccagagttgacaactgctattgctgaaaaatccatctacgaatacctagaaaataagttaggccttgatattgcttatgcacaaaaagagattacggtagagccgaccaatcgagaagagcgtgagctaatgcaatcgaaggatgattatttggtcttgattaaatctcgtgtctatctcggtgatacccaacaattccaatatacagaaagcaagcataaaattgataaattccgctttgtagattttgctcgtagaaagcattctttataggagagattagccaaatcaagttttttacgctataatagatagaagaagaggtaagatatggcaaacttaaatcgatataaatttacatttggcgagaagcaattaactttgacaactgagcatgataatttattcatggaagagattgagcgtattgcacaggaaaaataccaagccatcaaagaaaagatgccgacggcggaccctgaaaccctcgcgcttttgttggcaatcaatgctctatccgttcaactaacgcgcgagatggcatttgaacaaaaggaacaagaacttgcaagcgtcaaagaaaaggttttgaaaaagaatgtgaccttgattgacttagatgagcttgaggacaaggtatgatttcattagcaattattctcattttggcatggagtttctacattggctacagtcgtggtctagttctacaggccttctatagcatgggaagtattattgccctggtggttgcgacggctacttataaaaaattggcatccttcctttatctctgggtgccatttgccaatgctactcaggggagctccaactactattttgatgagaaatatctctttgacctagatatggtattttatgcgggattggcctttcttttgatatacgtcttggtttacgctattgtgcgtttcataggaatatttgtccatctattagaggcttttaatcctgatacaaaaacgaccaatctcataagcggcgccttggctgtcttggtgacttttatttctcttcagattgtcatggtcttgctatcaactattccgttagcgatgattcaagataaattgcacagtagttttcttgccaacatcatgattcagtacacaccattcactagtagctttttaaaatctctctggttgagtaatatagcagggtaagggaggccttatcctttttatcgtcatttataatactcttcgaaaatcaaaaccagacgttgttgatttgatgagtgggaaagactatatttttatcttttattgttttgataatgagataaagctaaggaaaagactaagtaggaatatatgaataataaaattattgaaacccttgaatttcacaaggtaagacaaaaaattgagccctatctcttgacggaacagggctttgaagaattacgacagttggagcccatggtggaagtccatcgtatccaacaggccttcgacgagttgacagacatagcgcagatttttgtggaaaatccctatttcagtctggctgctactagtgacatcggtccagccatgcgtcgtttggaattggatacagacctcaatatcgctgaattattagctgttaaaaaggtcttggaagtttctaaatctctcttggatttttatggaaatctggaaaatgtcagtcttagccagttggataaactctttgagaagattgagctttttccacatttacagggctccctccagtccatcaatgatgctggttttgtagaggattttgcctcagaaaagctggctcgtattcgaagaaaaatccgtgaagctgaagatcaagttcgtcaggtcatgcaggatattttgaagaccaagggcgacatgctgtccgatagcattttggcaagccgtaatggacgcaatgtccttcctgttaaaaatacctatcgcaataagattgcaggggttgtccatgacatttcagcttcgggttcgaccgtttatattgagccgcgggcagtggtgaccttgaacgaagaaatcagtcacctacgtgcagaagaacgccatgagctcaaccgtatcttgcaggaattgtcggatatgctccgtccgcatggtggcgtgattcgtaacaatgcctggcttatcggacatattgatttcgtccgtgctaagcatctctttgcgcgtgatcatcaagcagttgtacccaaactatctgagaagcaggatattgcccttctcaacgttcggcatccgctcattgctaagcctgtaccaaatgacctttatttcggtagtcagttgacggctatcgtgataacaggtcccaacacaggtggtaagaccatcatgcttaagaccttgggattgacccatctgatggcccagtctggtttgcctatcttggctgataagggcagtcgggtagctatcttcaaagaaatttttgcggatattggggatgaacagtcgattgagcagagtttatcaaccttctccagtcacatgacccacacggtggaaattttaagagcagctgatcaagattctctcattctctttgacgagttgggagctgggacagatccgcaggagggtgcgtctttggctatggctattttggatgaccttcgtctgcgggggatcaagaccatggcgaccacccactaccctgagcttaaggcctacgggatagaaacctctggtattgaaaatgccagcatggagtttgatagcaatagcctgcgtccgacctataagtttatgcagggtgttcctggtcgctccaatgcctttgaaattgcccgccgtcttggtctatctgatattattatccagtcagcccaatcttggacggatacagatagcgatgtgaaccgcattatcgagaaattggaaagtcagacggttgaaagtcgtcaacgtctggataagattcgtgatgtggagcaagaaaattacaagatgaaccgagccctccgcaagctctatgacgagctcaatcgtgagcgggaaaatgagctcaacaaggcacgcttggaagccaaggaaattgtagatatggcattggcagaaagcgaggatattctcaaaaatctccatgctgcagctagtcttaagccccatcagattatcgaagccaaggcagagctgaaaaagttggcgcctgaagtggtggatctgtctaaaaacaaggttctgaagaaagctaaaattaagagggaagccaaggtgggcgatgacattatcgttacagcttatggacaacgcgggaccttgaccaatcagctcaaggacgggcgttgggaagctcaggttggcttgattaagatgaccttggctaaagatgagtttgagttagtcaaggcggaaaaggcagagcagcctaagaaacgccaggttcacacagtcaaacgtgccaatgtacgaggaccaaaagcccgcttagatctccgtggcaaacgttacgaagaggctatgatggagctggatgaatttatcgaccaggcccttctcaataacctagcccaagtcgatattgtccacggtattggtactggagtcatccgagaaggggtgaccaagtacctacgccgcaacaagcagatcaaggagttcggctatgccccacaaaatgcaggtggatcaggctgtactattgtgacgtttaaatagcaatcaaccgatgggagattcttatgattatcagaaaatatcaaaccagtgatgaaaaaggctgggtttactgtaaggcactcagctacctcttctctccattctttgatgatagagaaacagagaagcccgaactaatgacagacgtttatgatcatcgtgtggaatgggtggctgaagtagatggacaaattgttggtctaatcgacatcgatatttacactgaggagtgcagccagtcttatatttacgcaccaagtaagcgaacagcttattttactaacctagcagtccaccctgattttcaagggcagggcattgcccaggcgctttttgaaaaagcagagcaggagttgagagcgcaaggtgtagagaaactagccatctttactcgtgaggatgatgcagccaaccatttatatcagaaatggggtggtgaggtagtctgttcggattatctagtggtcggagcgccacaagatgttccaaccttccgctttggaattgatttagagcgaggtagattgtccttttcagatatggaaggtcagccagttccctactatttgagagaaggtgtttatgtagtcagcgaagaagctggcttggatctctttgacatagaagatgtctatcaagaattaacctatgtggtggatttaacagaaaaaagttgaaacattttcaacttttttctttttgtaaatgaatctggtacgtgattcccccctcgtcctcctgcggtctagtttagctatacctattttttacaactgaaattcttataggtacgtttatctcatgcttcatcccgtagcaaaaattcgctttctgtttttttttggtgtagaatgatagtagaaaaacagaaacggagaaaattatggttcaagttattacagatgcaaactttgaagttgaaacacaagaaggcgtagtccttgttgacttttgggcaccatggtgtggtccttgtcgtatgcaagcaccaattttggagcaattggcagatgaagtggacgaagatgaattgcgtatttacaagatggatgttgatgagaatccaaacacagctcgtcagtttggtatcatgtctatcccaactcttttgttcaaaaaagatggacaggttgtgaaacaagttgctggtgtccacacgaaagatcaaatcaaagctatcttggcagagattggttaattgaaaatgaaagcaagtggtggatcgactacttgctttttttataatcagacttacttttgtgattattttctaatatagtcttttagtatttgctccaactatctgggagatagtgggaggttggaaatatagaaacgatatttcctagctcgtcgaagtaataaaagaaaaactaaatgacgatatttgctaagatataagattgtgaaggttggcacaagatgttataataaccttatcattgtcattttagaaaggttagatatgtcaactattagttacaaaccattaaatctctatcgtcagtttaaaacagcggctcaagagtttccaaatgttgccatttattttgacaaaccctacgcatctttccctgaattaggattggaaaatacctatcaaacagtttttgaagctattcaaaaaagagctgcccaatttgcagcagcaggtattggctatggggacaaggtaattctatataagagtccagcctttgatacctatttgttagcagtagcggtaacggcattgggtgctgttcctgttatgatttcctaccatttgccatcttcgaatttagatgtgtttgcggagcgattggaaaagtctttcattgtctacgaccaagaaacagaagaacgtgtagcaggaatgactcgaactgacctggtcacaaagatatttttaccccaagtcctagtgcaagaagcagttgcttttgaagaaaatctcctgccagaagatgtcattcaatacatgactcatacttcagggacgacaggtgttccaaaactaatctgccatacagcacagaccatgggctggcgagtagcttggcaacaaactatttttgacaagatgacggagagaggcttgctggccttccatatctcccctgtacattcacgctataatatcggcgtgtcgtcggcgattgggttaggattccccctctacccactttcttctgcaagaaaagatgatgttgaacgggcacttgctcttcatcgtccaagtgctctggaaacccatcctaataactttgtccaatgggcaagattggccaaggaaaaaccagaggtctttagtagcattcgttattaccattcaacctttgatgctatcaatattggtacgcttcgcgccttcttggaggcttctaaagagcaagatccagtctttatgcaggtttatggtcaaagtgaatgtggtccaatgattttacgttaccatcgcttggaaaacctaggaacagttagcggacgagatatggggattggtctggaaggttacacagaagcacgtatcacagatgcccaagggaatcctctcccagctggagaaaacgggcatatccagttcctgtcaaaaggccgtgctgtgacttactacaaagaagatgcccgcttccaagataatgtgtacggtgcttggtgggatagtggtgactacggctgcatgactccagagggcacgcttcttctaaaagaccgtcaggttgacctcattgagcacatcgacagcaaccttgccttggaagacttattgttggataaattggactttttatcagaagtcgtgattatccgcgatgtcaatggtgcaccgcagccgattatcgctctggcagaagatgctgagatgaactgggaagcttggtgggccatggttgcagacctaccactattgaaagagcccatcttgatggcttatgacgacattccacgtactgcgactatgaaggttcaacgcctcaaaatggaagcagaaatgaaagaaaaaaatctgtaagagtgacgaaaccacgcttgcagataagaaggagttcacatgaaagaaatttatctagcaggcggttgtttctggggaatggaaggctacttttcccagatcgatggtattcttgacaccagcgttggctatgccaatggacaggtggagacgaccaattatcaactcctcaaacaaacagaccacgcagagacgctctatctagcctatgatgagactcgtatcaatttgcgggaaattctcctctactatttccgcgtcattgatcctttctctgtcaatcagcagggacctgacaagggtcgccagtatcggactggtatctattacacagatgaggctgatttgccgaccatcgagcaggtcatgacggagcagtcccagctctttggtggacgccccctagctgttgaagtggagccactcgcacattacattcccgccgaagactaccatcaggattatttgaagaaaaatccccaagggtactgccatatcgatcttgggcaggcaaaaatccctctgattgatgttgcggactaccaaaagccagaccagcaagtcttaaaagacagcttgaccgacctccagtatcaagtcactcaagaagctgcgacggaaagacccttcgaaaatgagttttggaatagtgaacaagctggcatctacgtcgatattacgactggcgagccactctttctctcgacggacaaattcgactcaggctgcggctggccctcctttaccaaaccaatcagcaaagaagttgcgacttatttccaagataagtcccacggcatgaaccgtatcgaagtccgtagtcgggctggtcatgctcatttaggtcatgtctttgatgacggaccgcgtgataaaggtggtctccgttactgtatcaactcagcagcccttcgtttcataccgagagaggaaatggaagaagcaggatatggcctgtttttggatttgcttaaataaatttatgaacgcagaaagtctattcgcaaagaataggctttttgtgtattaaaattgtatgtttaaaaagatgattttgatataataatctatatagagattttatttaagatgtaaatgtacagaaaggttatgaaaatgattcttagtaaacgttttaaaaatagaagaaaggaacttggctttactcaaaaggagcttgcagagggaatttgtgagcagagtttgattagtcgagttgaaaaattaggagttgctcctacatcggatatattatttgccttatcacaacgcttacaggtgtctatggactatttttttgatgaaagtgtatcagataaagcgcctgatattacggtatttaaacgattggtggacaaagctctgttcactcgttcctatgatcaactggcttatcttgtagaggcagagaagcagaaagaagctgttcattcgcaggaaagcagtgaatatttaacttatctggcttgtatagtggactttcatcattatcataaggaggatattgcaattggatgtatggaagaacttagtcatcgaatcagtaagaaatctagtttttatctggatgtatacaacagcttggttaatttttatgccttggcttctcgagatgaggatttagatggtttgtatgaggggatttcagaaaagcttagccacttggatatatcaaacacagagtgttttcataagtatatcaagattcgctacaatcacgctcactatctttttaaaaggaagaggcagtcacaggcaattgatgaattgacagacctaattgaaacattgcgagataagaagagttgttattttttggcagatatgctttgtttaatcgcaaatgtcggagagggatttctatcaaaagatgaaattctctcctactatagagaagcagaatgtctattcaaattttttggtccgcaaaatagttatctcagtttaaaagaatatctatcaaaggttatttaataatcaagtatagattcttttataaaaataattaaaatggattgaaaatcgactgttaatatgttaagataaaataaaaaagctatatcaacgaacgtttgaaaacatgttgattttggttacgggttctaatgatagggaggtggtggagtccacctcctttttgtgcaaatggggttcgttatgaaaaaagtatttacttatttatctacttttagcgtctgtctcttctgtatatggttagtgagtctgcaactcgattctttaatttatcattactatccatcggtttccatattaagtcgaggggaagaagtgacctatgaagaagtgtcggatgccctgacaaatttagctgaaaaggaaaatagtctaattgctaagacaataacagaaacagatgatagtgggcgaactactaccagttatgatgtttttgggaagggggagcttccacagggcttggtcaaagcggataggttagtagctagtcaggccaacttagctgaaaattactatgttgtaaaaggtaatctggacatcaaagtggtagaaaacgtcttacagtcactgggattggtggatagctatatttatagaccgaccctattaaacagtttaagtctatttcttggtaggggagctccgagcttaggccttattatctttatactcaccaatcttgcattgacagtagttgggcagattgtctacttgcggtcggcaggtatagagatgctttcaggggtgaggagttggcagattgctagtcgttttttaagagtggatggaagagatatagcattggctacaggaggagcgcttgtttttggattaattgctattttaattttgggttggccaatggtatattatcgttttgtagcaatcggtatcgccttttatgcttgtttgctttttttcctatctttatcgacaagtattggattcatgattgcattaaacatttctcagttacaaaagctaattaagggagctttgcctctcaaggcgatttttgctattttactagtaggtcagtgtttagcggtttgcatcatctctattggtgctagtcgaacgttgacatatgttggagttctccatacactaacgataggagaaaaggcttggcaagaaagacaagatgtttttagtctgtctttgaatcgtgaagcattcatagctgatgaagcgatggcccagcaacaaagaatggcttggtctcatgtaattttagaatcatatgcgaaaaataatgtaatgttagtccagcaccatttacggcataacacaataaaagaacataccatcattgaatccagcaaggaaattcctctagaaagggtgctgtatgtgacgccgaattatatacaatcagaaggtggactgtacgatttcaatcagctggaagagataaagcaattaggtaaaggagaaattgcattattattaccaaagagtttgcaaaatgatgcgagtgtttaccaagcgtattttgaggacatggtaggaaaattgcttgcggatggagaaggatccataagtttgcattcaaatgtttattacatttccgatgagaagcgatggttcatttacaatcataccccgataaattatgagcaatttttacaggctccgttgattgttgttctatcacctgaaagttttgaagaaacgtcctatttttgggaaaatgcgttaccagattttgtatttttcaaagataaagagatgctggaacaactgttggacaaatacaatttacaaaacacaataggtagcttgttatctagcaagcaacattacaacaccctgagaaaaaatgttcaacttgaaattcttatgaccctatctccgacaatccttggaatattcacttccatactattgttcaatacgatgaatcttctatactttgagaccttcaaaagagaaatagccatcaagcggatagcagggatgggttttatcgaattgcatggttcttatctaggagaacaagtcggctccgctcttattgggatgggtttggcaatgtttatgacaaagtcagttattgttagcctaggagtagttgtggctttgttgataaatagttggatgttactgaacaatcaagcgaaaagggaagaaaaaatccagttgagtgtattaaatggcagatagttaatgaggtgaagttagaatgaaaggaaaatttgtacttgtatcgacgatcattctagccgtctttatgatttggttgggcgtcagtcaaaaggagactatgctagttcattattatccttctgtgactactttgtcggtatctgaggacgtgacatattcagatgtacgacagcgattagaagactattctcaacagacggatagtgtcattgccagacgagtgattgagccaagtaaatcaggtggacgtaccttttcttatgataattttagtcaatctcccctaccaagaggactagaggaatttcaggcatcagaaaaggtggagtctgcacttttaaccaaatattttattttccaagggaaagcgacggtagaggagcttcggtctcttcttgtttcgcttggacttgatgaagttcagattcggaagccttcgactattgctactttactcgtatttctgacccaaggtggtcaattcttagccgtactggtctttcttattacgtatatggctttggtcgtgattgctaatgtaaggcagttgcgtacagcaggtatccgtttgattgcaggggattcgcgctggcatttatttctactatctctacaggaaaatgcgaaagagatagctctaactatcccatttgcggttcttccagcagttggactggcctacctcgttggattagatggctattctgtctactatctggtcgcagctctagtgggctatcatttcttgcttggtttgattgtcctttttttcgctgctacatttaccttggccattcgaacctatcactttttacccttgttaaaagggaagatgcccctgcaagggatcctgaccattatggttatgggacaaatgctggctctattggtggtgtcatttgggatggctcaaaccgtctattattcagggatttggcaggaatatcaagcaggtgcccagcagtgggagaatgaaggggattactatagtttagcttggaatatttctgcggatggtcgctcaggactaaattcgcctgaaaattggtatcctttactaaggcaagctttggaggaagacggcgcactctttgtcaaaagtaatttgaatgcctatttaatgggcttccaactggaagatggaacacgccttgacagctaccatccagctggaaacaccctctacgttagtccaaattatttgcagatacaggatgtagacttagcagaaggagaagtagcgctccctttacaagaaggagaatttcaacttctgttgcctgaaaaattgcgccctgaaagcgatgcttatctccatctttaccaagattatatcaatcgtatggttagacctgctaatcaagcacgctcagctaccattaagggaaaagttgcctatttaaaaaatgggcagaagcagtttatctacaatcatcgttctggtcaacatgtgcaatacctgacagaccctattttagttgtgctggcaccgtcaagtctgggaaaagaatctgctgacttttggttgaatgaagtagatagcagtatgctatttaaaaacagagataaacttttacgtgaattgaaggcaagaaatttgtttcagtttgtcaatgaagtgagaagtagttcttccctctttacggaacttttagatcgtattcggatagagaccatttcaacatctatgggtgccattttagggattgtgacatcaattgtcctgtttaataccatgaatcttctatactttgaagaatttaaacgtgagattgtcatcaaggaaattgcagggatgggtttcttgggaatccataagaaatacctaacgcttcaactgctttctctcttgttggctcttggagcaagtatggtagtaacaggtcacatttttataagtagcatcagttttgccttgtttatggtcaatgccctctgtttattgaggtggcaggcgaggaaagaaggagcttggaatgtccgtattttgaaaggagcctagtatgttttctgtccaatcaattcaaaagaaatttgggaagcgcagcttgttttctgatgtaacactagacttgcaggctggaaaggtctatgccttgataggtgccagtggtagcggaaaaacgaccttgctgaatattttagccaagttggagtcctatgatgcaggtgacattctctacaagggaaaggatttgaaaaagttgaagccccatctcttttttagggaggaattaggctatctctttcagaattttggtcttttagaaagtcagacaatcaaagaaaatctggatttgggactgattagtcagaaattgtccaaagacgaaaggaaatcgaggcaggaagcggcacttgatgcagttggtctgtcttatctggacctgtcccagcctatctatgaactctcaggaggggaagcccagcgggtagctcttgctaaagtcatcctgaaaaatcctccattgattttagcagatgagccgacggctgccttggatcctaagagctcccaagaaattatggatattttgttatccttgaagagcccagatcggttaattgtgattgcgacccataatcctttgatttgggagcgagcagaccttatcataaaaatggaagacttgtaaaaattcatactcttcgaaaatcaaaattatccgttgtcaacttaccttgatgaactccagttctatcttcggcttcgtttcctaggctacttttgattttcattgagtatcagaaaatattcttgattttttcgtgaaattagattaaaataaaactagataaaactgaataaccggttgatattgggtagaagggaaactgactgttcaatggacggaactctggagagaccattttggcaccgaaggggcaaggtagtcctgcttggaaaagtagagctactgaaactctcaggtaaaaggacagagcgttgaaaaataggctttttctgtatttttcacgttgattctagaggttgaagtgttcagcctctttttgtttttccggcagctttatcgggttagaaacgcttaggaggaactatgttagaactatttaaggctatcaacaatcttgtttggggaccgcccctcttgttactattggtcggaacgggtgtctattttaccctacggttgggagtatttcagattggcaaattgccgacggcttttcgtctgattttctccagtgaccagtctggtcagggagatgtgtccagttttgcggctctgtgtacggctttagcagcgacagttggtacaggaaatatcgtcggagttgcgacagctattactacaggtggtcctggggctcttttctggatgtgggttgcggcctttttcggaatggcaaccaagtatgcggaaggatttttagcgattaaataccgaaccaaggatgccaacggtcaagcggcaggtggacctatgcattatatcaccttggggatgggacagaagtggaaacccttggcagttttctttgctatttcaggtgtattagtagctctcttggggattggaactttttcgcaagttaattccatcactgcttctttggaaacgagttttggattggaaccgccacttgtcagtgtaataacggctatttcaattgccttcgttgtttttggtgggattgaaaaaatctctgacgtttcgaccaaaattgttcctttcatggcgattttgtatatcttagcaagtattactgtcttggccgtgcattgggatcaactcttgccaaccctggccttagttttcaaatctgcctttactccagcagcggctgtgggcggttttgcaggtgcgactgtgcaacaagcaattcagcgtgggattgcgcgtggggttttctcaaatgaatctggtttgggttcggcgcctattgctgctgcggctgccaagtctgataatccagttgaacagggcttgatttctatgacgggtacctttattgatacacttatcatctgtaccttaacgggttttacgattctagtaactgaccagtggtcggtagagggcttggcaggtgctcctcttactcaggcagcttttgcaacagtttttggcaatacaggatctattgccttgacgattagtttggtactttttgcttttacaactattctcggatggtcttactatggtgaacgctgtatcgaattcctctttggcaccaagtctatcttgccttaccgtctggtctttgtagctatggttgccttgggtggtttcctcaaactagacttgatttggaccatcgcagatattgtgaacgggctcatggcactaccaaacttgatcgccttactagctctctctcctgttatcatcaaggagacacgccagtattttgcaaagaagaaataagataaaagtcagccacttggctgtctttttgttcttttagggtgttttctgctataattatctcatgaatgattttattaccaagtatttgtctcaatttaatattgaggccattgtgacagcaggtctaaataaggttttatcgcttgttttactctttgttgcattttacattatcaagaagatagccaaagcttctgtgaaaaaggttttggttccctctctaaaggtatctacccaagacattggtcgtcagaagaccatcagtcgtctggtggaaagcatcctaaattacctactctactttatccttatctactgtattttgagtatcctcggtttaccggtatccagtcttcttgcaggagccgggattgctggggtagctgttgggctgggcgcacaaggttttctctcagacttggtcaatggattctttatcttaattgaacgacagtttgacgtcggagatgtggttaagttaaccaacgggcccattaccatttcaggaaccatcgttagcatgggaatccgaacaacacaagtacgtgatgcagatgggacattgcattttattcccaatcgcaatattctagtggtgtccaatcagtcaagaggggacatgcgtgctcaaatcgatattccgctcaaatttaataccgatttggaacaagtctatcgcgtaatagaagaggtcaatttgagagaaatcagcaattttgaccagattacaggtgtgactgtattaggtccccaaaacgctatttcgggacagtttgtatttcgtgttaatcttttcgtagccaacggtcaacagaacaagatctatcatcaattctttggtttttatcaagatgctctgcgtcaagcaggaatagatttaccttcaagtgggccaactgttttaaaataaggagtttattatgcaaacaaaagattttgtcgttgaaaatgggcagatgtattataagaagaaacccttgcacaaacagcctctcttttggacgaccattgctggtgccgtcctctccttcatcctaggagtaacctgttttatttttatgatcggcctaagctcagcaaattttgataattgggatacaggtagtgacggatacattgatgagactgtggaatacacagagtatcaagttggtgactcagttgatttttctaacggtcttcatgtaacagtaacatctatgggcaaagacgatagcatagaactagtggatagctactacagcacagcttatgttgttgaaatggaagttgaaaattcgaccgcaaaagagctctattttgatgaatactatttcagtctcatggatcccgttagtcagattccctttaccctggatttgcggacctatgatgtgaatctagttgaaaagttgaagccaggagagaaagtacaagtaaaacttatctacggtatagataatgaaacaaactttggttttacctacgaagatgccatgtggacggaattagtcgcagaaggtatctaattgctgtagaaaaagttttaaatattgcacaattttgcggttttataacgccccttggttcagattgttcggcttggtaattgtactatatccgacttatctgttatttttacatttaaaaaaggagaatatgtttatccactgttctcctcttcttttaatgaaaaatacccccaaaattagcacgtcaattttgggggcgtttttattatagtttagtaaactaaaagtaagcttataccaaaccttgggcaatcatgctatccgcaatttgttcaaaggctgcgatgttagcacctgcaaggtagtctgtaccaaggtcgtatttttcagcagtttctttggctgtgttgaagatgttggccatgatgtctttaagacggccgtctacttcttcacgagtccatgacaagcgaaggctgttttgactcatttcaagggcagatacagctacaccaccagcgttggcagcttttgcgagtccgtagagaacgccattttccttgtagactttgatggcatcaaggtcagatggcatgttggcaccttcagccacacagtacacgccattttttacaagggcagcagcttgtttgccgttgatctcattttgagtcgcacatggaagggcaatatcagccttgccatcgtagttccatacagaacctttgaagtacttagcagttgatttttctgcagcgtattctgtcaaacgagcgcggcgtttttctttgatgtccaccaagaggtcgaagtcgataccagtttcgtcaatgatgtaaccatttgagtctgaaacagaaataacttttgcaccaagttcagtcgctttttgaacagcatattgggcaacgttaccagaacctgagataaggacagtttggtctttgaaggatttaccgtttgctgccaacatgttatcagtgaagtaaaccaaaccgtaaccagttgcttctgggcggatcaatgaaccaccgaagccaagaggtttaccagtcaagacacctgcatcaaactggcggaggcgtttgtattgaccgtacatgtaaccgatctcacgaccaccgacaccgatgtcaccagcagggacgtcaagtgaaggtccgatgtgtttttgcaattcagtcatgaagctttggcagaagcgcatgatttcagcatcagtttttcctttaggatcaaagtctgaaccacctttaccaccgccgattggaagaccagtcaagacgtttttgaagatttgctcaaaaccgaggaacttcaagatggattggtttacagttgggtggaagcgaagaccgcctttataaggacctacagctgagttgaactgaacacggtagccacggttgacttgaacatttccatctttatctgtccatggaacacggaagctgatgatacgctcaggctcaacgatacgagccaagatgttttcttcgatgtattctgggtgtgcttcaaaaacaggctcaagtgtagagaagagctcttctacagcttggaggaattctgtttcatgtgggttgcgggctttgactgcttcaaaagaagcttggatgtaagctttggcatttgacatgggatcacctgatttcttttttatttattaaattgtctgacaatttaatttatctgataattattatagcaccatgatttttaaatgtaaagaagaaaatgtaagaatttaaaaaaattaataaatttttattgcaaaatccgaatgttagtagtaaatgaagaaaatccgtttgtttcttatgatataatcaagaaagaatgacctatatggaggataagatggtttcaacagtaacgacactcggtggatttacctttgataattgtttgatgaatgcagcaggggtttggtgcatgaccaaggaagaattggatgcggttaagaactcgaaggcggggacttttgtaacaaaaacagcaaccttggactatcgcgcgggtaatccagaaccacgttatcagaatgttccgcttggttctatcaattcgatgggcttgccaaatcagggcttggcttactatttggattatctactagaattgcaggaaacggagccagaacgcacatttgttttatctgtagttggaatgtcgcctgatgagactcatgaaattttgagaactgtagaagccagtgattttaaggggctgacagagttaaatctttcttgtcccaatgtccctggaaaaccgcagattgcctatgattttgaaacgacagaaaccatcttgcaggaggtcttcacttactttaccaaaccactcggtattaagttaccaccttatttcgatattgtgcattttgaccaagcagcagcgattttcaaccagtttcctttgaagtttgtcaactgtgtcaattcgattggaaatggtctttatatcaaggatgagtcagttgtcatcaagcctaaaaatggttttggtggtatcggtggagagtatatcaagccgactgctcttgccaatgtccacgctttttaccaacgcttgaaaccggagattcaaattgttgggactggtggcatcttgacaggtcgggatgccttcgaacacattctctgtggtgccagcatggttcaagttggaacaaccctgcaaaaggaaggtgtggcagcctttggacgcattacggctgaattgcaggccatcatggctgaaaaaggctacgagaccattgaagattttcgtggcaagctacagcacttagatgactgagatcatctgttgaagacataaaaagaagctaacattgtactgttctcccagatagtcttttagggagtcgcgaggggataatgttagctctttttaaatggtctgtgaagatcggtctgataatcgtttgaggaatggaatacatagtcagaaacatatatttgtgagatggaattctgattttatttagattttttagcaaaaatatcgtatactaatattagaacctctatttataagtgatgtgcttttatggaagaaatagttttttgagggactgctgactgtattttgaacaaaggttcttaagtagggagtatgagggtaaaggtatggagagaagggcgaactatattcgcagaaaacgatatgcgtcctatcggacaaagatgcatttgttttttatttgtggcttagcgactattatcttggcgattattattgtaagcgagcacctagttcctaggctgaatcaggcctcagaatcaatgcactcagataattctgttcgcatcatggctcatggggatttgctctatcacttgcctattcttcgaggagcagaacagccagatggaagttacgatttttctgagaattttacctacgtaaagccctggatagaacaggctgatttcgctatcgcagactttgaagggaccatttctccagatatcgaattagcaggttacccactttttaatgcgcctgccattgtcgccaacaatatccatgatgcaggctacgatttggtggacttagcccacaatcatatcttggactcacatctatcagggctgatttccactgtcaatacatttagagatgcaggtgtggatacagtcggtgtctacgccgaaggcaatcgggcaactgcaccactctacattcgggaagtcaatggtatccgtatagctgtcctagcctatgcttacggtttcaatgggatggaggctttgctgagtcaggaggaatatgatgcctatttatcggattttgataaagaaaagatgcgggcagagattgagcgagctgagaaagaggcagatattaccatcgtcatgcctcagacgggtgtagaataccagttggagcctacggaggaacagaccagtttgtaccatcaaatgattgattggggagcagacatcgttcttggtgggcatccgcatgtagtcgagccgacggaaattcttgagaaagatggtcagagaaaattaatcatctattctatggggaattttctatccaatcagcgtatcgaaagtatggaagataccccaaatgcccagtggacagaaagaggtgtcttgatggaccttactattcagaaagagaatgggcaaacaagtattcaaacggctcaagcccatccaacctgggtcaatcgcctttcaaaagggacttattcaacagatggatacgaacaattttcctaccagacttacattttggaagactgggtcgctggtggtcgatactatggacaattggatctagatacacaggcgcgtgtggatacagcctatcaagaaatgaaagactttgtcaatttggtatggtgaggagagagaagatgatagttcgattaattgcaacagacatggatgggacctttttagatggtcaggggaattttgatagagagcgattttcacgggtcttggatcaactagatcagaaaaagattccttttgttatcgctagtggtaatggaattgggcgattactacaattatgccaaggatttgaagacagattaatctttgtagcggataatggagcccatgtgtatcaaaatggcaagacagtaattcgtcgggctattcagcaagtggaagtcgaagcaatactgcattttttcaaaggccgttgggcggatgtatgtctgatgttgtcgaacgatggaaatatttatatgcaggctggggcaggtatgccgtttgcaggaactgatttgccaatagaactagctcagatggctgccttccaaaatcgtgtgacatatttagacaaccttagtgcctatccagtttcagagtcaatacacaaggttggtctctgggttcctgaagcgcgtgtagaatcgataacggaagcctttaatcagggttttcacggtcagttggtggctgtaaccagtggttatggttccgttgacattctaccgcagggtatccataaggcttggggcttggaacaggttttgaccggtctagatatcgaacctgaacaggtaatggccttcggtgattcagacaatgatattgagttattgtcctatgttgggtattcctatgccatggaaaatgcgacagacaaggtcaaggcggttgccaaatacatggctccaagccatttggaagctggtgtgcttcaggtcattgaagaatatatcttataagtatatagaaaaaagctagtgctctcaatccagagaatgctagctcttttaatttccaacgctggtgaacttggtcataccatagcggaagaggttataattgatggaaaataggaccactaccaccagaggcaacgccagtccccacatagacaagtctaggaagtagagagcagggaagtaggcggtaaaggcgtaggggaaaacaaaaatcagcaggatttgaatgatttttggatagatattgagtgggtattgagccatctgattgagggcgaaaattcccatagtcaaaggaaatgattccacaatccaaaatgctagagcagttggaccgagctgaatggctgcatagagtaggccgatacaaatggcaataaagattagtaaggctagttttccaagactccattccatgcctagctcatttgaagcttggactagtgcaagggaaccgatgagggttgttccgattccttgtggctggattcgttcacagataagttgaaaaagtgggttcacaggcatgaggaggaggcgttcaaattcgccttgtcggatgtagcgactgccaaacatccagagattgtcaaagaatatcaggtgaatggagcgtccgacggtcgctattccatagataaaaagcatttgaccgtagttgaaaccagcgatttccttgatatttccaaagagaatattgaggaaaatcaggtagacaatttgttcaatcaaagaggagaaaagcccgatgaagaagtccacccgaaaggacatctgggccatcatgtagaccttgatgttatagagatagaggctgatatatttcttcatgttaacctccaaaaatgacaatacgacgcttggcttgggaccaaagagcagcaatgaagcaggctaggatgggtatccatataacttgcaatcccaaagcagttagatcgctttcctgtcccaataaaatggaaactggaacgttaaccgcataattatagggaaggagcttcaaaaagttttccacagcctgtggatagaagctgagtggcaaaagcgctccagaagctagattgaaaagtcccattctcagaagcatgactccccaggcattgaccgtaaaaaatgctaagaagccaaaagccatatccagtaattgaacgataaacatccctaggatggagctgactagaaagagcaaaatagtttttccgtcaggtagataaaaatcctgatgaacaagtaagatgccgataaatacgatagcaaattttatcagttccaagagcttatttccaaggtctttgaaaaagagagctaggataaaggaatagggtctgagaaattctccagcaatgcttccttttaaaatgctgtaggataaatcttctccgagtgagaaagaatttaaactggctagtagattagcaaagatgatatatgtagtaaaggtttgtagggtaaagccattgacttctgattgagtgaagaaaatggttttccagacatagagagctaccaaaatcttcactgccagtgaaacgaaggtcgctagaaagaaagccttatactgcatagcattcatcatggtcaggcgggtcatgtagagatatttacgcatggataccctcctcataaatctgacggaccatggtttcaatttccaattccttcatggtgacatcttcaattgaataatgattgaaaacttgctcaatcacctgggcgctggtccagaccttgctttggtagtggatttcaaagtgaaaatcatctttacgaataaattcccagccctccaattgcaaatctttttcaattggtttttctgtggagaagagaatggtcttgactgtggaaaagcgttctttgaggacggtcagtgaaccatcgtagaccttcttgcccttatcaatgataaaaatccgctcacagaggctctcgatgtccttcatatcatgggaagtaatcaaaaaggtggtctggtattcttgattcatatagcggatgaaggagcgaatggtctccttgacgctggcatccaagccgatggttggttcgtccaaaaaaacaacggcaggctggtggataaagatagccgcaaattcacagcgaactcgttggccgagtgacagattacggattggttgcttcataatatcagccaagtccaatagctcaatcaagacagccaatcgctctttgaataccttatctggaacatcataaatttttgcgtgaaggataaaagattcttggacaggtaagttccaatccaagtgagatttttgtccaaagagaacgccgatttgcttattgacagctttgcggttttcttgtggattgagtccgttgatacgaacctgtccttggtctgggaagaggactccagtaagcattttgatggtggtggatttaccagaaccgttggagccgatatagccgatgatttttccttttcctacctgtaaggaaatgtcttgaacagcagggattgactttttctttggcttgaaaaaggccttgatagagccttttagaccgacttccttatcaatgattgaataggtttttgaaagatgttctgcctgaatcatatcataatctcctatttgaaaacgtttgcgtaagataaggatattataacatattccccagaaagtggcggtaaaaagtcgcctttaaggtaacatttttattagaaaatcggtcatatattgaggagattcttgcttaccatttttaatccatacctgcatgataccgaagaaggcatgtgaaaaatagatgctgctgtattctttttccagttgtgataaattctcttttcctaagcgctccgctaaatcattggcaacaagaagtcggactttattgataagaaaattttggatttcttgagttccgttatgggtcagtagggcagaaagcaatttttcacgatagagcaactcgaaaatttctaaaaatgatgattggcgattgccatcataatggtcaaatatagcctctaatttgtgaaaaagtccctgttgataggagtcgattaattcatatttatccttataatgggtataaaaactggaacgactgataccagcagtctgggctaggtgtgttgttgtaatgtcattaaatccttgtgattccaggcaggttaccatggcttctaaaattgcctgtcgagttcgttctttccgactatctgttctcataatttctccttttgaacatttttagacacagtgtctaaaaacagttcttctgacttgattttgaaattgatacttgtataatgtattttatcagtttttggacagtatgtctaaaggagttgcttatgttacaaaaagtaaagaatattttcaaaaaaccaatgaccttgattaccattctaggtattgcctgtgtcccagctttgtataatattagttttctaacttctatgtgggatccatacggccgactagaccagctgcctgtagcagttgtcaatcaagaccagtcggcgagctttcaagataaaaccctcacaattggtgatgatatggtggacaatatgaaagagagcaaaagtctggatttccactttgtatcagaaaagaatgcggagaaaggcttggaagaaggggactactatatggtcatcactctaccagaagatttatcagaaaaagcaaccagtctcttgacgaatcagcctgaaccgataacgatttcttatcaaacctccaaaggtcatagctttgttgcttctaagatgggcgaatcagctatggagaaattaaagacatctgtttcagagacaattaccaaaacctacacgactgccgtttttgatagtatgagagaaattcaaaccggcatgatcgaggcggcagatggtagccaaaaattaacaaatggagctagtcaattggagtcaggcagccaaacactttcaaatggactgactactttaacgacttcgggtcaagtactcgtgacaggagcaaaccaattggccaccggagttgtgtcttatacagatggagtcaatcaggctgcaacaggcagtcaaacactgtccagtggcttaacgatttacacaaatggggtagcgagtcttgtttcaggtgcggagcaattaaatgccaattcctctcagctcatcactggggtgggacaattgcaatcaggagcaagccaggttgaacaacttgtaacgggagccaatcaattgcaggcaggcttggaacaactcgctaattcaactagtttgtctgctgaacagtctagtcagatacaagcactcttgacagggcttccacagttgcaggtggctatcaatcaattaaatgacagcctatcaagtatcggaggacttgcagttgataactctactctatctagcctcttgacggagatgggggctcaggctcaaggcttgttgacagcagcccaagctgataaaacagccagcatcgaagccttgcaaaccacggctacctatcaaaacttgacagctgatcagcaagctgaattggttggtgccctccaaaattcaccttcggcaacagcgacagtagcccaaacgattttggatcaattgtctcagctcagtcaaaccctttctagcctacaaagtctttctggcatggcaacacaaatgaaccagctacaatcagctgtcggtcagattaacacggctgccaatcaagcattgccaggagctacaacagccattgaaagcctatcaagtggcttgagtcaggtcaacacagctttgaaccagcaagttctaccaggaactcaaaccttgacgagtggtgtgagtcaacttcaaacgcaactgtcaagcggagcgagtcaactcatgtttggagtaacagcctataccgcaggtgttgctcaattagcagcaggtggagcccagttggttgcgaataatagtagtatccaatctgggggtggccagctaacatcaggattggcaaccttggcatccaactccagtcaacttgtcagcggttcagaacaactggcttctggtagtcagcaattaattgctggtgcggatcaattagctagtggtggccaagccttgacaagcggtatttctagtcttcgtacaggtagtgagaccctaacgaattcactcagctcagccagtcaacaactatcagtcgtctctgtagaagacaaaaatgcacaagcagtttctcaaccagtcaccttggaacacagtgaccaagatgatgtgaagaccaacggtgtcggaatggctccttacatggtatcagtcgcactgatggttgcagccttatcagcgaatgttatttttgtcaaacacattgataatcgctcctacaagaatcgttgggactgggccaaaggaaaactcttgctcaatggtatcattgccagcctagcagcagtgattctgtacggtgttcttcgcttgattggaatcgaaccagctcatccaatggcaaccttgggaataatcctcttagcctcttggaccttcatggccctcgttacagccttggtgggctggaacaatcgtttcggatccttcgcaagtttaattatcttgttactacagcttggatcaagcgcaggtacctatccaattgaactcagcccacgcttcttccaagtcattcagccctatcttccaatgacctattctgtttcaagtcttcgtcaaaccatttctatggttggaaatagtagtcatcaagtttggatgctaagtctcttcttagtaggctttatgggactaggtctcttgatttataatcaaaaagatgaataagaataaaaccaactgctccatgtgaacagttggtttttggttgatgtggttatttgggggtccctaaattgattgtcgcattggtggcttcaatggtcagtttgttcttgctacctttgttttctagggttagggtctgtagatcgttttcagtcttgacagggaatttggtgtacttatcgctagtgaaaataccgacttcccctagtcgctcttttaagtaagggtcttggttaaccatctctcccaaatcattcccatcttcatagtagtaaccttgggcttctactaattttttcttgtcgatctggttggtgatgagcaagttgctatctgccaggctcttgtccgtcacatccaaaaatgtcgtagaggagtaggtgtcggatggagtgaaacgattatcgccaagaagagtcgtttgtctgctatccagctggctatagccctcgatggtcacattttccaaactggtttcatacaggcggacgctgcttccctgtaggttgatgtgcatatcttttagagtggattgtgtcgcttggaagtagcctgcttcaatctgaccgctgtcaatagtcaccttgtcaagagtgacaccaccagacagatttgcctctttgatatggatattctcaatcgtgaaaccgccaaaatcatagaagtggagattgtgtccctctaatttatccagtgtcttccctttaggcacttcaatggtgacggagaagacattgatacgacgctgggccaagctttctcccagatactgcatgattccctcaatggcaaattctagttcctgtgcagagagggttaagacgccgtctttctcactgagttttagagggttttggatattgttgtcggagttggcataggtcacatgatagttgttatcactagactctttgatgtagacgctgtgggggataaaatcaattttaatggtattcaaatctgtgaaggtcttatggacttccgtcggagcagcaacctcttctaagcgggttatgcctccggtgaaaaatccaatgccagctagaattaagcctgcaatcaggctgacaaagccgataataatggcgatggtaagtttctttttcatgctcgtttacctcgtttcaaaatccatttgaagcaagccttgaccagtcgccaagaccagtaggcaaaaaatccagtcaagatgtagatgagaatagctccgccaatcaaagacaaacctgacccaaaccccatgaggaagatattgaaaccttctgacataaggctaaaggcttcccaaattagatagccaccgctggtgagaagtccgacacccaaaacaaaggcaccgacaatgagggccaagatgagcgccaccaatcccaatagactagctaggagaatgagcaaaagtggaatggcgataggcagggaaatgacagctaggatagccaaccagagcgttcgttttgtttggctaaaattacggaagtagcgaccgaggaaaaaagcgccgaggataagagtcgcaaacagaggaatgactccgataaactctcccatgataaagagtaggaagaaagagaagagacctgtcatacttaaggctcccagaccaacccagagtttccagttgagttgaataggttcttgttgatccttctcctcctggatttgcttgttgagcatgttgttaatgagttcgctggcagcttcttttggggaaccaagttcttctataatttctgtttcacgctctggtccaacctcgtcaaaatactcattaaagaagctgatggcttcaaagtattctttgtggggcagttttttgagatatttttctaactgctccatatattcagttcttgtcatggcggacgctcccttctatgatgccgtttatcgtgtttgtataggtatcccagtcatctttgagtcggaccaattcttcgtgacctaactgagttaggctataatactttcgcatacgaccctgatattcttgggaataagtagtcaaaaagtcattttgctccaatcgttttaggatgggatagagggcggactccttgatgttggcaattaatttaatggtctgacagatttcatagccataagaatcatcggattccaaaatagccatgatgagaaattctgtcagcactgcggggactggaaaatgcataggacgctcctttcctttgttgttagttaggttcggttttgatatatagtgttcggttgcatatatcaaatttttctatatattaaatatacacctacaaaaataaattgtcaagtgattatgtgcaaaataaataaaataacttaagaccaaatagcttaggacaaatttttaaggtgtaaacgttttatagccttgaaaaataatttcagagtagtaaacttaataacagtactaacattaagggattttctggactaaaagagaatgacctcagatggattagtagtatttaaggtggtgtaaagatgaaactatatgttcagtttatgattattctggtattttcatttttaggggaagctatttcgactatttttcatcttcctattccgggaagtattattggcttaatcctcctatttttagccctagagttcaaattgattcgtcttcgccatattcatacggttgggaattttttgctggctaacatgaccattctttttttgcctgcagcagtgggcattatggagagatttgatgcaattaaagattatttacttcctattatcgtcgtcattttaggcgccatttttttaaatatcttagtaattggttttgttgttcaatttgtgaagcaaaagtttgaaggcgactacattgatgcggagggaaatcatgactgaacttttttccaatcctatttttggtattatgttatcaattgcagcatatttaattggaatgctgatttatcggagatttcctcatccaatcacaaccccactgttggtagctacaggattgattattgtctttttaaaaatgacaggtatttcctataaggaatattatgcaggagggtcctatctaaatatgcttattgtgccttcaacagtagctctgggtattcctttgtatcgttctttccatctaatgaaacatcacattcgaagtattcttttgggaatttttgttgcctgtattgtcaatactgtctttactgccctaattgcaaaatggtttgggatggatttttttctagcaatctctctttttccaaaatcagtcaccactgctatggctgttggtattactgataaaatgcaaggaatagcaacagttactcttgtagtcgttgttgcaacaggaattctgacaagtgttcttggtccagtctttttaaagctactaaaaattgaagacccggtagctgttggtcttgctttgggaggaacaggacatgccattggaacgggtacagcgataaaatgtggacatacacaaggagcgatggctggcttggctattgggattacaggcatcatgtatgtggtgattagtccaatagttgcgcagattatcttacaataaaaaactacgattggaattccaaccgtagttttttagtctacataaagtttggattgattattcaaccaactataaagaagtccgataaagagaccgcctcccacgtagtttcctaatccagaaaagaggaaattgcttagtacacttaatagagtcattccctcaactggtccaccatttgcaaaaaaggccagggagaagagtgaaaagttcgcaatgacgtgctcatatcccaagaaagcaaagataaagatgatgaaaataacggaaatgagacgtccagcgtcatctttgatgcgtaagaaggtaaatacgccgatattcacgacaatattagcaaaaattccttcaataaattgagtcaaaggtgtctttgaaagcttggccaccgttgcttcaaataggtagctgtgagcatcaacgtgctgataaggcagagtcagtgagaccaagtaacaaacaaggacagcaccgacaaagttgaaaaggatacaggttgccaacatcttgagggctgttttagtaggaatcgtttttcgatggctggctactgtcatatacatcatgttggatgttccaagttcggcattcatatataaaatcatgagtagcccccaaccaaacatcaacccatagctaaatttcccgagtccttctgcgacatggttgagtttgtctgctgtataaagagaaatgacaatccccaatcctaaataaagactggctagtattgatcgtacagcgtaggcagaaaaactgtgttcaaacaaatctgcttttttcttgatactcttttcaagtgtatacattaatgtctcttggttagctcccatcctaatctccttactgaatctactactttttcgagtaaacgttttctttttatcgaatggctttactttgtttattatacttgataaaatggttgttgtccaaaaaaaattcaacttttgaaaggaaatataagaaaaatatggatgttacatggacagtgaaatatatcactgaatttttagcgactgcactccttattatcattggtaatggtacagttgcaaacgttgatttaaaaggcacaaaaggaaacaactctggttggattctcattgcgattggctatggtttggcagttatgatgccagcattgatgtttggtaacgtttctggtaaccatatcaacccagccttcacacttggtttggctgtttcaggtctcttcccttgggctcacgttgctcaatacattgttgcccaattgttaggtgcaatgtttggtcagttagtggttgtagcagtgtataaaccttacttcttgaaaactgaaaattctaaccatattcttggctcattctcaactatcagtgcgcttgataacggaacgaaagaaagccgtaaagctgcgacaactaatggtttcttgaatgagttcgttggttcatttgtattgttcttcggtgcccttgctttgaccaaacatttctttggttcagagttggttggtaaattgattgaacagggctatgataaaacagtcgctgagacaatgactgctccatatacttcaggttcaattgcagttgcccacttaggcattggtttcctagttatggctcttgttgccgctcttggtggtccaacaggtcctggtcttaacccagcgcgtgaccttggtccacgtatcgtccatgcccttcttccaaaatctgttcttggtgaaaacaaggctgattcaaaatggtggtatgcttgggttggtgtatgtgctccaattatcgcatcaattgccgctgttgcacttttcaaattcttgtatctataatatagagaacccgtttcgtcgggtttttctttttctcttggtatatcctatataaagttgtctgctctgctattttcctaaaagttatgctacaataaggatagaaaaatcggaaaagaggctagaatatgtcagatgttattgcttttggctatggaagcagtcgagcgaagatgcagctcaagcggctcaatcgtcatggaatcatcgcaggtgcgacaggtacagggaagaccgtgaccttaaaggtcttggcagagcagttgagtgatgcgggaattcccgtctttctatcggacatcaagggtgatttgaatagtttggttgcggccaataccaaggagattgatcctagtcgtctagagaagactcattatcttgactatagcccagtcggttatccagttgagttgtgggatgtcttgggggaaaatgggactcctatccgcatgactatttcagagctgggacctgtcctactgacacgtttgttgggcttgaatgatactcaggagtccatcctgaatattgttttcagcgtggcagacgagcgtggtctgctcttgattgatttgatggacttgcgggctatgttaaactttgtggctgaaaatgcggcagagctgagccagtattatggaaatattccagctcgttcggtcggtgctatcttgcgtagtctggttgttttggagcaacaaggtggtaagattttcttcggtgagccaagccttgatattgctgatttgatgcgtacggcagaagatggtcgtggtgttattaacgtccttcaagctactcagctatttaatcagccaacattatattcaacggttcttctcagcctcttatcagaactctatgaagtcttgcctgaggtgggcgatttggacaagcctaagatggtcttcttctttgacgaggctcatgttctcttcaaagatgctccaaaagttcttcttgaaaagattgaattgattgtccgtttgattcgttcaaaaggtgtaggtgtcttctttgtaacgcagaatccgacggatattcctgatagcgtggcagcccagttgggtaaccgcatccaacatggtcttcgcgcctttacaccaaaagagctcaagacagttgctactgtcgctgaaaccttccgtcaagaaggtgatgaggatttggccaaggtcattcaggagttgcaagtgggggaagctgttgtgtctacccttcaagcagatggtacaccaagctttgcggatcgggttttgatttatccaccaaagagtatgctgggaacggtggagccaagcgccctcttgtcagttatcaataattctcctttgatggaaaaatatgctgacgcggtcaatcgtgaatcagcccatgagcagattttagccatgacagaggctaaagaagccgaactcatcaaaaaagcagagcaggccgaggcggaaaaacaggcagaaaaagaagctaaggcagccgcaaaaatggaagagaaagcccagaaagaagcagctaaaactgcacaaaaaactagtcagccagccagtcgcaaaacagactctatgatggatcgttttaccaagaacctgatgagtcaggtcggacgggaagttgggcgcgtggtaactcgtggcattatgggcatgttaaaagggaaataaacgactagactgggaaggaaacttctcagttttttatctagacaaagttcttgccagatgccacaaaattcgttaaaataaacacaaatcactagttagtaaggagttgccatgactgatcaattgcaggcattattgaaagactatcagccccagccattgggtgaaaaacgttcttatgcagttttcttgcccttagtctggtcagacaatcagtggcaggtcttatatgagattcggagcgagtccatttctcaaccgggagaagtttcctttccaggtggcggagtagaggtaggagaaacgccacagcaagcggccgttcgggaggttatggaggaactaaatattcaacctgaacaaattgatatactcggagaaattgattatttggttttggagtgctcaaccgttcattgcttcgttggacggttaaatcttgattggacgactatccttcctaatgaagaggttgctcggatatttacagtgcctctatcaactctattaacaactcagccagtctattatcaactggattcacagattgtcccagattgtgactttccctttgaacgtttgagaggtggggttgactatcctttcagtcatcacaaacgctcggttcccttttatgaaaatctatcagaaaatatctggggaatgaccgcccaatttacccatcggtttacggaaatagtgaaaagtaatctatcgtgaaatgataggttatttttgggaggaaaaaccagcctttgcgatatgtatcaacgaaaaaaatggagacaaagctcaatgtgaaccaatgtatataaaaacacaaaaaaaacagatgcatggcagataaaagatagctatggctggtatacttggtacggtccatattttgaagtaccatcatctatccaggaatgcgacaacattcatgtaaacgcattcagtgcttgttgtcatttccagtaggtgagtgggaaaatgtataaatctatattttaagaaggagccaattatgagcaagcagaaagttgtgtccagtttattattaagcacagtcgtattagggggattagccttttattcaacgacaacggttaaagcagaatcgctagaaccagatgttacatcagttaatgcaagcgatgctactaataaaccggtagtaccaaatgaagagggaggcgactttttagctgaagaggagcttgaagatgatgacactttggaagaagaattaaatgagaaagccgaagaggttactgagccatcttcacctgaagcacttctccaacctcgtgcgatgatgagtgattctgaaactagtggtatggaagaaattccgatgaatgatgaaccttcagataatacggaagaaaaggtagagaagcaacagtcgccattaattcaaacctcaaatgcagattataaaagtggtaaagatcaagagaaacttaggacatcagtatctataaatctgttgaaggcggaagaaggtcagattcagtggaaagtaacttttgatacaagcgaatggtcttttaatgttaaacatgggggtgtttattttattcttccaaatggtttggacttaacaaagattgttgataataatcaacatgatataacagcctccttccctacggatattaatgattacagaaattctggtcaagaaaaatatcgtttctttagtagtaaacaaggtcttgacaacgaaaatggttttaattctcaatggaactggtctgctggtcaagctaatcctagtgaaacagtaaacagttggaaatcaggcaatcgtttgtctaagatttatttcataaatcaaataacagatactaccgaattgacctatactttaactgctaaggtaactgaaccaaatcagcaatcattccctcttctggcagtgatgaagagctttacgtatacaaactctaagagtacagaggttacttcgctaggtgcacgtgagattacccttgagaaagaaaaaactctaccacctaaggagaatccaaaaccagagccagaagctccaaaaccagacgctccacaagcgccatcagcaccggaatctccaacggaagaacctaagaaggaagacgctccgcaaacaccacaagcgccatcgactccggaaaaacaaccagaagtaccggaatcaccaaacccagagacaccagacgcgccatcgactccaaaagatgaaccgcaggctccatcaattccagaagaaaaaccacaagtaccggaagagccaaaacaagaggctccatcagctccgtcaactccggaaaaacaaccagaagcaccggaatctccaacggaagaacctaagaaggaagacgctccagcgccatcgactccggaaaaacaaccagaagtaccggaatcaccaaacccagagacaccagacgcgccatcgactccaaaagatgagccgcaagttccatcaatcccagaggagcaaccaaaagagactccagcgccagaagaacctaagaaggaagatactccgcaaacaccacaagcgccatcaactcctaaagaggaagcaccgaaggaagaagttccaacaccaccggctccatcagtaccagaagagcaaccaaaagaaactccaacaccagaagttccaaaacaagaagatgttcaaccggaagcgccaaaatctgataaagtagaatctgacaaacaaatgccagaaactaagaaaccagatatgaagcaaccgaaggcagacgacatgcctaaggaacaaaagccgaaagccgacgagccaaaggcagagcaaccacaaatggacaaaccacaaatggaagctcctaagaaagattcggaagcgccaaaatctgataaagtagaaactgacaagcaattgccagaaactaagcaaccagatatgaagcaaccgaaggcagacgacatgcctaaggaacaaaaaccgaaagccgacgagccaaaggcagagcaaccacaaatggacaaaccacaaatggaagctcctaagaaagattcggaagcaccaaaatctgataaagtagaaactgacaaaccaatgccagaaactaaacaaccagatatgaagcaaccgaaggcagataaaccagaagcagagaaagctcaaatgccacggacagagggtatgaagcctgaatctaaggcttcaatgatgccaaaagcagaggcaccaaaagcaactttgccaaatacaggcgaagcaagtagcgcaataggctggctaggtggtgctttagccactcttgccacaggcttgtatctattcaaaaacaaaaaagaagaatagtcattattgaataagatataagaacttccctcttctaagttcataaaagactccagatcatcgctgtagaagccttggtttggagtctttttgttaaatattcttagaaaataacaaaatagataaatattagataccctctagaaaaaatttagtttaggatgttatactaacgctaaaacaataatatcaatttttgaaaatactagattggaataaaaatctaatcgccatattttagaacctgtacttacaagtaaagagcttttatgtaagagatagtttttcgctaatcaagttaattttttgagggaatgctggctgtattttgaaaaaacgaacgatgagtagcttaaaaatgccttagatgggagtgctaacctgtaaatacaggttcttagtaaattgaagtaaatagagtaaaggagcacattatgagcaaacaaaaagttgtgacaaatctattgcttagtacagctgtactaggtggttttctaatatgtcacgcaccatctgtaagcgcagaaacaggcaatcttcaagaaatacctactgaatctgctacggttagctcagaaaatcaaactgcgaccgcagtcgatggaatttcacctacggataaccaattacctacgtcagaagagggtgataaacaggctccagaagaaaaactagtttctagcgattctacgagagaagaaagtgctacgcaggtagcgacagatccggatgcaccatctcaatcattaagtgtgtcaggggcggaaatttcaacggcagattcaaatattcaacaagccgaagagaaactgattcaagaatcgaattattatagatttgacacgcatcaaggtgaacagattaggaaggcagtatctatagaaaaaatatcggcagataatgacgaaattaagtggaaagtaacttttgatagaaaaaattggacctttagtggagaggggagtggctattactttattcttccaaaaggcttacaattaaccaaaattattgatagccagtctgaagaggatattttcaataagttccctaaggatgtcaatagtgaggcaaattctggcgggcagccgtatcgcttttttagtagagaaaaaaatgctaataatgatgagcgtagttttgaaagtcagtgaggttggtctgttggacgtgtaggaggagagctagaaaaatggaaggaagaaagttccagcatctattttctacaagtacagcgagattccgttgctaaagaaaaagcgacatatgaactgacggcacaggtgacaaatcgagaaatgcagactttcccggttttagctgtggtgaagaattttaaagagcgaatatttttctccagagatgagattacttctgctgctggtttgagattaaaggtatcggaaagtgctaagccaaataatgaagggattactattatcggagattcatctccagaaagcgacaggactcctgaaccgcggggagataggactccggatatagatgtaccaaaggcagaggttccaaaagttgagcaaccaaaaccaaaggcccctgaagttcaactgcctgctcctaaggctccggaatctgtgccaccaaaagtaatgcctccagcccccaaagttccagacgttaagacgccaaaagttgagtaccctgatacagatgctcctgagattgagtcaccaaaagctcctgaaactgaacgaccagaagtcttaccaccgacgccaaaagtcccagaagttgaggttccgaaagtaattccaccgacctcaaaagttccagaagctgagctaccgaaagttgagcagccaaaaccgaaggttccagaagttcaccttcctgctcctaagtctccggaaactgagccacccaaagtaatgtccccagcccccaaagttccagacgttaagacgccaaaagaggcgcctctgccaccaaaaactccgggcgttgaggttccgaaagtaattccaccgaccccaaaagccccagaagttgaggttccgaaagtaacaccaccgacctcgaaagttccagaagttgagacaccgaaagttgagcagccaaaaccgaaggttccagaagttcaccttcctgctcctaagtctccagaagttgaggttccgaaagtaacaccaccaacctcaaaaattccagacgttaagacgccaaaatctccggaagttgcgcacccagaagttgagaaacccgccggaatccaaccagaaaagggtcaacctgaggttaataaacccaatattatccattcggaggtgcttcaatccgaagttaagaaaacggaatctggagtttcaatggctccaaaggtaggaatacaaaaagagactttaccaaatacgggtgaaacgagcaacaccctagtatggctaggtggtgctctagctacccttgcatcaagtttgtatcttttcaaacaacacaggcaaagagaagaggaatgattttacgctaatgctatatttttggaacgccaataaggcttatctaccatggactaagaaaatttagaacagttgtaaatagaaaacgttccaaaatctgaactgcaccccaaaagttagaggtgaaatctaatttttgaggtgcttttcttgtaaggtcaagacacaaagacaagattgaaatttatcgtttgcaatgatatgaaggagttggttatatattttgttttatcaatactagtttgaatgttattcgagaatttgtaggacattctgaggatggtaaggagatagtgaaaatctatcttcatgtaatacaaaaaggaaaacgtaagattgaacaggctatgctagatttagcagaaattatcatttgatttattttaatcagttaaaattcagttattttgtcaaaaacaaaagaaaaaagcctttgaaacgttgatttcataggctttctgtatgttgtcttattttacctcagtaaaaatcacgtgcttacgcaattttggtgagtattttttcaattgaagacggtctggagtgttacgtttgttttttgaagtaaggtacaaacgctcaccagattctttgtgttcaagtgtaatatttacgcgcatggtatctcccttctattattcagctgaagcagccttggcaattttacgtcctttgtagtatcctttcaaagatacacggtgtgaacgtgagtaatctccagtagtttcatcaaatttcacagttggagctgctactttatagtgagtacgacgtttgtttttcttcgcttttgaagtgcgacgtgcaggtactgccatttctttcttcctccattaaatgtcagggtcaagccctttttaaatctaaaaatagtgcgtatgactttcgccaactttaacagtataacaaaagttttttgtaaagtaaagttacttgacagatttttttcacttttttggaaaatagcagagcatttatggtaaaataaggaggattgcaaggctcgactggtagagtttgagcccttatgacttaatttggaaaggaagaagcacaacttcgagcgatataagttggctctatacactttattatgaaactacaaaaaccaaagggaacacaggatttactaccgcaggattctgccaaatggcagtacgtggaaaactttacccgcagcattttcaaacagtacaattacgctgagattcgcacaccaatctttgagcattacgaggtgatcagccgttcggttggcgatacgacggacattgtgaccaaggagatgtacgatttctatgacaagggagagcgtcatatcaccctccgtccagaagggacggcaccggttgttcgctcctatgtagagaacaagctgtttgctccagaagtacaaaaacctgctaagttctattacatgggcccaatgttccgctatgagcgtccgcaggcaggtcgtctccgtcagttccaccagattggtgtggagtgctttggttccaataacccagcgacagacgtagaaaccattgctatggcctatcacttctttgaagagttggggatcaaggacattcgcctccacctcaacagtctgggcaatccagagagccgtgctgcctaccgtcaggctttgattgactatctgacgccgctcaaggaacagttgtctaaagatagccagcgccgtctagaagaaaatcctttgcgtgtgttggattccaaggaaaaagaagacaaggttgctgtggaaaatgcaccgtccatcttggactatctagatgaagaaagtacagtccacttcgaggcagtcaggtccatgctggacaacctaggcattacttacacaattgacaccaacatggtacgcggtttggactactataaccatactattttcgagtttatgacagaagtgggtggcaatgacctgaccatctgtgccggtggacgttacgacggtttggtgacctactttggtggaccagaaacgccagcttttggctttggtatgggcattgagcgcctcatcctagtccttgaaaagcaaggcatcgagctccctctcgatacccagttagatgtttacatcgcggttttgggtcaggaggccaatggcggagcgcttgatcttgttcaagccattcgcaagcaaggtttccgtgcagaacgtgactatctggaccgcaagctcaaggcccagtttaagtcagcagatgtctttggagccaaggctatcattaccctgggtggtagcgaaattgaatctggacaggttgtggtcaaaaataaccagacaagaagtcaagttgaaacaagcttggaagcacttaaaacagattttgcaagtattttagaagaattggagaagcagtagtctaaagctgcttctttttattttagaaagcaaaaaagaagcgattggataatcacttcttgaaaatagtggagaacgcattagtgtgagtggcagaagtctaagaccatacgaccttggatagtaccggcaaccatttcattgaagactgcttcggcatcttcgacagggcgtttttgaacgactggaacaactagtcccatagcaccgaagtggaaggcctcttctaaatctttacgagtaccaactagtgagccgaccactttgataccgtctagcacagtcttcacgatactgaggtccatgtattcagatggaagtccgacagctactacatatccaccagcacgaacactgtcaatagcttggttgaaggctactttggaaacagctgttacaacagtagagtgtacaccgccaccagtaatttctttaatatatccaggaacatcttctacttcaagtccgttgatcgtcacatctgcaccaacttctttggcgagttccaatttatcattattgatgtctacggcgataacatgagcgttgaagacttttttagcgtattgtacagcaaggtttccaagtccaccagcaccatagatagcaatccattgacctggttccaagtgagcttctttaatcgctttgtagcaagtaacgccagcacaagtgatagaacttgcttgagctggatcaagaccttctggaacttttactgcatagtccgctgttacaatacattgctcagccataccaccgtcaacagagtagcctgcattttttacggtacggcagagagtttcgcgaccggttgtacaatattcacacataccacagccttggaagaaccaagcaacgctgacacggtcaccaacttttagactggtaacaccaggtgcgatttctgtaacaataccgattccttcgtgaccaagaacgcgaccaggaaccttaccaaaatcaccattggcaacgtggaggtcagtgtgacaaacaccacagtactcaatttggaccaaagcctcaccagcttcgagtggacgaagttccttttcgacaacgacaacaccagtagattctggatttacaacgactgctttcataagcagacctcctgttttaatattttatgtacatttttggatgtgttaatatagttgttttatattgttaagaatatcacaatgtgaacaaaaatgcaagagtagaaaaggagggacaaatgaatataaaattgaaaattatcacgtaattactacaaaattttcaaaaaaatctatttacatggaagcgttttcttgataaactagtatcgtaaatgttagagaaagaataaatgataaagatttgtcttactttatgtatttttcgaccaaacaaagcagaaacaaatctgaacgttttctgaaaacaggaaaaagtaagcgctttccaaaacaaaacagaaaaaatgtgaaaaaattaacaatttctctttacaaataaaataaaaaatagtagaataacattgtgaaaaagttaacaaatagttagcaagtatatttggaggaacacaatggctgataaaaaagtagtatcaccagaagaaaagttggtagaagcgcgcaagcacgtcgatgagcttgttcaaaaaggtttggttgctcttgatgagttccgtaaacttggtcaagaagaagtagactatattgtagcgaaagcttcggttgcggcccttgataaacatggcgaattggcaatgcacgcctttgaagaaaccaaacgtggtgtattcgaagacaaggctactaagaacttgtttgcctgtgagcacgttgtcaataacatgcgccatacaaaaacagttggtgtcatcgaggaagatgatgtaacaggtttgactttgattgctgagccggtcggtgttgtttgtggtatcacaccaacaacaaacccaacttctacagcaatctttaaatcattgattgccttgaagacacgtaatccaattgtctttgccttccacccatctgcgcaagaatcttctgctcatgcagctcgtgttgtctatgaagcagctgtggcagctggtgcccctgaaaactgtatccagtgggtaacaaaaccatctatggaagcaacgtctgagttgatgaaacatgatggtattgcaacaatccttgcaactggtggtaacgcaatggtgcgtgcagcttactcttgtggtaaacctgcccttggtgtaggtgcaggtaacgttccagcctatgttgaaaaatcagcaaacatccgtcaggcagcacatgacatcgttatgtctaagtcatttgacaacggtatggtctgtgcgtcagaacaagcggttatcattgataaagaagtttacgatgagtttgtagcagaattcaaatcttacaaaacttacttcgttaataagaaagaaaaagctcttcttgaagaatactgcttcggtgtgaaagctaacagcaaaaactgtgctgaaggtaaattgaacgcagacatcgttggtcgcccagctgcatggatcgctgagcaggccggcttctcagtaccagaaggtacaaacatcttggcagctgaggttgctgaaatcggtgagaaagaaccattgactcgtgagaaattgtcacctgttattgccgtcttgaaagttgaaggtcgtgcagaaggtcttgaagcagctcgccaaatggttgaattccacggtctcggtcactctgcagctattcatacggaagacgcagaattggcgaaagagtttggtacaatcgtacgtgctatccgtgttatttggaactctccatctactttcggtggtatcggtgatgtttacaacgcattcttgccatcattgacacttggttgtggttcttacggacgcaactcaatcagtgataacgtaagtgctatgaacttgctcaacatcaagaaagtaggaagacgtagaaataatatgcaatggtttaaagttccttctaaaacatacttcgaacgtgactctatccaatatctccaaaaatgccgtgacgttgaacgtgtcatgatcgttacagaccgtgccatggtagaacttggattcctagatcgtatcatcgaacaattggaccttcgtcgtaataaagttgtttatcaaatcttctcagacgttgagccagatccagacatcacaacggtttataaaggtacagaattgatgcgtaccttcaaaccagatacaatcatcgcactcggtggtggttcaccaatggatgctgccaaagttatgtggctcttctacgaacaaccaacagttgatttccatgacctagttcaaaaattcatggatatccgtaaacgtgccttcaagttcccagaacttggtaagaaatctaagtttatcgcgattccaactacctcaggtacaggttcagaagtaacaccgttcgccgtaatctctgataaagcaaacaaccgtaaatacccaatcgctgactactcattgacaccaactgtggcaatcgttgacccagcactcgtattgacagtacctgcacacgttacagcagatactggtatggacgtattgactcacgctacagaagcatacgtttcaacagtagctaacgactttacagatggtttagcacttcaagctatcaaactagtatttgaaaaccttgaaagctcagtgaagaatgctgactttgtatcacgtgagaaaatgcacaacgcatcaactatggcaggtatggccttcgccaacgcattcctaggtatttctcactcaatggctcataagattggtggacgtttccataccgttcacggtcgtacaaacgctatcttgcttccatacgttatccgctacaacggtactcgtcctgccaagacagctacatggcctaagtacaactactataaagcagatgaaaaataccaagacatcgcacgtcttctaggcttgccatgctcaacaccagaagaagctgttgcagcatacgcacaagcagtttacgacctcggtgaacgcatcggtatccaaatgaatttgaaagcacaaggtatcgacgagaaagaactcaaagaacactctcgcgaattggctcttcttgcctacgaagatcaatgtaccccagctaacccacgtctagcaatggttgaccacatgcaagaaatcatcgaggatgcctactacggttacaaagaacgtccaggtcgcatcaagtaaggattttcgtcacgatacatcgttaaagctccttgcctaactttagttatgcctacgtcgctttgccttgtctcgtttagaaaatcattccttagtgatttagattcgccttcgtcaatctgcctagaaaggcttaggactagaaaaagtctaggtaggagtagtaaatcgtatcctactcagttgaacggagtaggatttataggtaaattgcctccaaatatcgtaagacaatcctctattgaaaaataggggattgtttgtttagaaataatggtggagattctgtaaaaagcgaaagtggttggaaagttagggtttagccgagaaaaagagacttttctatctatctttcacaattttctgtcaatttgtggtagaatagaaaaaatagattttttatgagggataccatgacattagtatatcaatcaacacgcgatgctaaaaatactgtatcggctagtcaagcgattttgcagggcttggcgaccgacggtggtttgtttacaccgctttctattccaacagttgacttggatttttctgttttgaaagatgcttcttatcaagacgttgccaagctgattttgtcggctttcttggatgattttacggcagatgagttggactactgtatcaataacgcctacgacagtaagtttgacacgtcagttattgccccagtggttaagctaaaaggtcagtacaacttggagctcttccgtggctcaaccattgccttcaaggatatggctctgtccatcctcccttacttgatggcgacggcgactaaaaagcacggtttggaaaacgaaattgtcatcctgaccgcgacttcaggcgatacaggcaaggcagccatggctggttttgcggacgttcctggcacacaaatcattgtcttctatccgcgtgacggggtatctaaggtccaagaattgcagatgaccacgcagacaggggctaatacccacgtggtggctattgacggtaacttcgacgatgcccagaccaatgtcaaacacatgttcaacgatgaggcactccgtgccaagttggcggctaagaaactccagttttcatctgccaactctatgaacatcggccgcttggtgccacagattgtttactatgtctatgcctacgctcagctggttaagactggtgagattgcggcgggcgacaaggtcaacttcaccgttccaacaggaaactttggaaacatcttggcagcttattacgccaaacaaatcggtctgccagttggcaagctcatctgtgcgtccaacgacaacaatgtcctaaccgacttcttcgcgacaggcgtttacgataagaaccgtaccttccgcgtgaccaccagtccgtccatggacatcttggtgtcttctaacttggagcgcttgattttccatctctttggcaatgacgctgcaaaaacagctgagctgatggaagccttgaacacagctggtcagtatgacattcaaggggctgacgcggaaatcctctcgctctttgctgccgcctttgcgacggaagaagaaaccgctgcggaaatcaagcgtgtctatgacgagtcagactacattgaagatccacatacggctgttgcctcagctgtctataaacagtatgtggagcaaacaggggaccaaactccgacagtgattgcttctacagcaagtccttacaagttccctgtggttgcggtagaggcggtgacaggccagtcaggtttgtctgactttgaagcccttgcaaaattgcatgagatttcaggtgtagacttgccaccagctgtggacggcttggaaacggcacccgtccgccacaataccgtcgttgcagctgccgatatgcagactgaagtagaacgctatttgggtgtttaatttcgatttattttatgacaaactgctcattttgaacagtttgttttctttttgtggtttaaattaaaatttacagataattcaaagaatgatatactatataggaatactgaatagtgaggtggatgatggcacaagagcaggagaaaatctccagagaaaagaaaaaagccctcttgaagcggctcaaagaacgcatcaaacccaagatgaagctggtttatttggcagcctttctatcatgggtgcaatttttgatgcggattatttccttttatctgattgctaagggctttgtgagctactatgagggtggtcaggttgatctggtacgctttgtcctcatcttgctggggctcaatgcttttggctatggtgtggctctgattgccaagcgtttgcaggggctgggctcccagtttgcacgggattcgctcaagcagtctttctttgaggttcttttggccaaggatggtcagtttgcgtccaaagcgacggcggcggatgtttttaacatcgcttctcaggggattgatagcctggatacctactattcctactacatggcttcgtccttgcggacccagttcaactgtgcgacggttctcttgctggtttttctgattttcccgctgggtgcagtcattttcatcttggccttgcctctgattcccatttccattatcgctatgcagaagcggtccaagcggatcatgaatcgctattggggttcctatatggatgtgggcaatcttttcctggatgacctcaagggcctcaacaccctctattcttatcaggcggatgccacctacgaaaagaccttcaatgaacaggccgaggacttccgcgatgcgaccatggagttgctcagctttcagttgcaagcggtgggctacatggatgcggtcatgtatctggggattggcttgtctggttttgtggcggtcaatagcctagcagcaggcaatttgtccctctttagtatgctcttctttgtcctcattgcgacggagttttttgcacccatacgggaacagggctacggtatgcacttggtgatgatgaataccaagatggcggatcgcatttttggtttcttggacagtatgacagcggagcaggaaatcgattctgtccatgtgcctgcttttgacagtctaaaactagaagatttggcctttgcctacggagaaaagccggtcctagaagatatttccatgaccatgccggctggtaaggtatatgctttggccggcgagtcagggcaggggaaaacgaccttggcccagctgctcttgggacgcttgcgggcggataagggagctatttacttgggtgagcaggagatttcaggtatcagtaagctttctctgaatgagcaggtcctctatgtgtcgggccagtcaaccttgcttaaccagtctatctaccataacttgcggatggcttgtgactggtccaaggaggacatcttggcttgggcagatcagcatggggtcttgcagtttgtcaagaatctgccagacggtttggatacgattgtgggtgatgacggtgctttcttgtcgcctggtcaacgccagcaggttatctgtgcccgtgcggtcttggctaaacgctccctttatatctttgacgaggtgacgtccagcgtcgatcaggacaatgaaggcttgatttacgacctcattgacttggtggccaaggatgcgattgtcatcatcataacccataagatgaaacaggtggagcaggcagatgacatcctcttcctgtctgcggagggagctgtgacaggcaactatgccacgctttatcagactagcttggcttacggtcaactggtcgatcaacaaagagaattggaggaagcagtttatggataagaaagaaatgccaacacgagtgctgattccgagactcttgcagtccatgaagcacctcttgccacggattgcggttgcggtttgctttgcggtcttgggacaggtggtgaccattgctattccagttatgctggtctatctggctttcaatgcccttactggcaatcctgctccgctatggaccttgggaatcctcattctcctagctcttttacgtggtgccttccgctatggtgagcattactttggtcattatgtggcctttcatacgctggcggcttaccgtcgcttgattttcgcaaaattgcgggccttggctcctgggaaattggaccggcaggacagcggtagcctgcttaagatgattggggaggatattgaggccttggaggttttctttgcccataccattgccccgatttgtacagggattttggtggctcttggtttgacggtctattttggtctatctagttggggtttggcttttctggctctggtgacctatgctcttttagcgattgctattccaaatcagtttgctcagcagttacaacccttgctcaaggagcaaaatgctagccgtaagggctatgtgtcctactttattgaaagtcttaagagcatgaaggatctcatgcagttccagcagacagatgctcgcttcgccaatctgactcagaaaagccaagaggtcaatggtcaggagagaagggtcgcccagaccaacttcatgcagtatgccgtctccttcttggtggtcggcttgtctatcatgggctttgcctggctgaccttcgacttggtgggtagtcagagtttggacttagcaacaggagtagccctgctggtttctttcattagctcctttgctcccttcttggaactcagccgtctgcctcttggtttcaagcgggctatgaatgctggtcgcaacatctatgctcttttggatgaaaaagaagcagagcgaacaggtgagcttgttgaggtcagcgtgacagacattgctattgagcaactggacttcgactatgatgtccgagaaacaggcctttatcgtaacctgtctgtccagtttgaacagggaggcatcattggtctggttggtgagtctggtgcaggaaaatccaccttgatgaaactaattatgcggtggtatgattggcagcaaggccaaatccgcctgtctggcttggatagtcggcaggtagataaggctcatttgcagggggcttttgcctatgtaccacaggtgccacaaatcttccgccagaccattcgggaaaatcttgtcttgggtcgtacggatatatcggatgaaaccatcatggacttggcagaaaaatgccatatgaaagaacggattttggcagcaccgcagggcttggatacgcttgtggaggccagtgatttttcagcaggagaggggcaacgcttggaactcatgcgggccctgctcaaaaatgcggattgctatatctttgatgagccaactagtaacctagattcgctcaatgaagcccgctttatccaactggttaaggaacactgccagggcatggtcttcttgatttctcatagaagctcgaccatggcttgtgcggataccattttccgcttggaagacggacaattagtaaaggaaaaataaatgaagaaattacaagtaaaagatctgatggtaacaggggcttttgctgccctctactttgtttgtgttggtctaggaaccttgttgagcttggtttttgatcgttcgggtaatatgatgtatgcacctgcgggagcagcccttttggcaggacctgtttatatgttattggtagccaaggttggtaaatttggttcaattagtctggttggagcagtaatggcctgtttctttttcctatcaggctatatgacagcggcctttctcccaagtttgacctttggttttttggcagaaatggtagcgaagtcaggtcactataaacaaaaatggaccaatctttttagctatatcattttctcttttggaaacttaggacctattattcttatgtggttcatgcgagatgcctatgaggccaatcttttggcacgtggaaaatcagcagaatacatcgctcgtgtcatgcttgatttcactccagagaatgtgctatggttgtcaacgaccattatcttaacagctcttatcagtggtttgtttggtcaatatatgcttcagcgctattttaaacaatcaggttatctttcatgaaattagatgctcgtacaaaaattattctcgtcatcttcactagttttacctatgggatgaggcttacaatattagaaaatgcagtgctggtcttaggccttagcctgcttttctggttttctggaaagcggaaaatggctataatgagtccgatagcctattctattttttgtctgttgtcctatattacatttttaccagcatggctgacgcatttgttacttgtattgacctatacatggcctccgcttttggcaggacatctattactgatgacgacaagtggttacgaactcattcatggcttgcggaaatggcacctgccagaggtatttcttttgacgttgggagtaatgtttcgtttcctacctgccattaaacaggatgctcgtacgatttgtgcctctttgaaggttagaggaatttttttacggaagagagatgtggtttgtaagccactccagtacatggagtttttcttggttcccttgatgatgtctctcttgcgaacagctcaggaattgacagtagccagtctgacaaaaggtttggctgtgtctacgaaatcacctgcatatatttggtcgtcttggaccgtgctagattggagtctttgtttatgttgtctcggttttctgattctcgtccggctgtgacggtaaaaaatgtagcattaacttattcaggagcagataaaccagccttgcagatagaggatctgaccattccagaaggacagtgtgttgttttatgtgggcagagtggttctgggaagtctagttttctcaaggtattaaatggtttgacgccagaatattatcctgctcagctttcgggacaaattttcttaggggacttggatttacaaaaatctagtctggaagaaatatctcggcacattgcttcagtctttcagcatccgtctactcaattttttcatagtcaggtcttgcaggaattggttttcccttgtgaaaatcagggtttgtcaagagaagaaatcgagaatcgcctggcttgggttatggaattatttggtttggcttctcttagccagcgaacgatttccagtctatcaggtggtcagcaacaacgtctagccttggccgttgcaactatgcaagggacagatgtcttggttttagatgagccgactgccaacctagatcaggaagggattgtgattgtagaggacatcttgaaaactttaaaaagccaaggcaagaccattattattgccgagcatagactgtcttatctcagtcaattggcagatcgctatttatattttcaagatgggcaagtggtgacggattatctagcagatgagtttttaagtcggacagaagaatgccgtcaggatatgggactgcgttgttatgactcggagccttatgggcgggcaatagcggagctggcagaccagtttgttaatgataaagaggggttacttgttgaaaatttatcggtaagtcagaaagagaatactctctacgagattgaaaaactctgcttggcaccaggacaggtggtgggtttggttggagcgaatggttctggaaaaacaagccttgctcgttatctggtcggtttagcggaagataagaagagtaggatttcttggcaaggtcaaaccttatctagtcgccagagattggaaaaaacagcctttgttatgcaggatgttcgactccaactatttgcggaaagtgttgagcgagaacttactcttggaaggaaaaatagagctgtcgatgaacatttggtggctcgttttggtctatcggatttgttggagagacatccggtcagtttatcgggtggtgaacaacagcgcgtgatgatagtagctagcttactggcagataaggaaattttcatttttgatgaaccgacgagcggcttggatttgagacgaatgcaacaagttgcttccgctttagtagacttaaaaatgaagaataagttggttttgttaatttctcacgatgaagagctattgaatctggtttgtgataaaatagtagatattaaacagttgaaatagtgattatgaacaaacaaacctataaagaaattttaaccattgcctttccagccatgggggaaaaccttctccagatgttaatgggggtagtagactcttatctagtagccagtattggcattgtagctttgtctggagtttcccttgctaataatattttagccgtctatcaggcggtttttattgccctagcagtagcggtgtcttctcgtttggctcaggctttgggtgaagggggttcagaaggcattggaggaactgctagtgaaagtgtcaagtttacagtttttatcggtctccttttaggaattttttcagttctggcaggtccaatagtacttactagcttgggggcagagtcagaagtggtacaggctgggggtctttatttgatattggttggtgggggagcaccttttttgggactcatgacaagtttgagtgcaatcttacgaaccttgggggaaccacgttttcctatgtatatcagtctgctctcaaacgttctaaatgcactattttcagcatttgcagtctttgtgcttcatgcaggtgtagctggagttgcgattggcacggtattatcgcggttgattggttgtagcctgctttggtctcgcttaccaatttctttaaaaccatggacctggtcctttgataaagaactgcttagacttgccctgccagcaactggtgaacggttgatgatgcgggtgggagatgtggtagtcgtggcgttgattaccagcttaggaacagcgacggtagctggaaatgcgattggagaaaccctgacgcagtttaactatatgccggctttagggattgctaccgcaacaatcatccttacagcgaaacacagacaggataaggctatggttcgacatatttttcgaacaagctttggcctttctttgctgtttatgtttttggtggctggtgtgacttattttgcggggtctttcctaatcgacctttatactaaggatattcaagcagcacaagctagtcaaacagtattattttatgccatgttgggagttccctttacagctggcactcttattatgacagctctttggcaaggtttgggaaatgctagattacccttttatgccacaactatcggtatgtggctagtgcggattggcatagcttatttacttgtaacattttttaaaatcggtttgtcagccatttggattgcaacgattttagataatgccttccgatcaggggtgctattttttcagtataggtattcaaaacaagaatcaatttaagataaggctaagaaaattttcagtttcttttaagtttgtagctatatactatattcaagctagaaatagcgaacaactttctttttcatataatctcctagagaacagtcggccgcggtcggctgttttcgtgtgttctattcttatgtaaaaatggtataatagtagtgattgtgtaaggagaaaagtatgtcggtagtaggaaaagcaaatggaaaaatcattttgatgggagagcatgcggtggtctatgggcacccagcaattgctatgcctttttctgctgttgaaattattgctcaggtaactgctcaaggggaagcgctgactgttgcttgtgacttctataaaggcttagttcacaagatgccaaaaatctgggaaagcctcaagcatgccatccgtttctcgctctatcgtatcggagcgccgacagacccagctattcatatcgagattagttccaccattcctgccgagcgtggcatgggctccagtgcagccgtggcagttgcagtagcacgcgccctctttgcctattatgaaaaagagctgaccgacagcgaactctgggacatcgtccagtcttcggaaaaaattgctcacggcaatccctcgggtattgatgcggcgaccaccagcggcaagtcccccgtcttctttatcaagcaccagcccatcgaaccttttgagctgaaactccatgcccatttggtagtggctgacacaggtgtgacgggaaataccttagaagccatttcagacgtggcagatttgttggagaaaaagccagaggctatcaagctagtagaagaactggggaacttgacccgacaggccaaggaagatttagccacagaccaggcagagcttctaggcagcagaatgaaccaagctcatgccctcctgcaaaaattaggcgtgtctgatcctagcctagataagctagtcagccttgcccaagaaaatggagccctcggagccaaattaactggtggcggacgaggcggttgcatgattgccctggcaagaacagctcaggatgcccaaaaacttgcacacatccttgaccaagcaggcgcccgccaaacctggatacagtacttaggagaaaccaatgactaaacaaataggcatagcccgtgcccataccaatattgccttgattaaatactggggaaaacgcgataaggaattattcctacctatgaattccagtttatccctgacccttgacgcattttatacggataccaaggtcgtttttgacccagaattaactgctgatgagttctatctcaatgggattttacaaaaagaaaaagaaattttaaaaatttctcgatttttggatttattttgcgaatatataggtgaaagggcatttgcccgagtggaaagtctaaattttgttccgactgcagctggtttggcaagctcagcatcagccttcgcagcgcttgcgcttgcaaccgcaactgccttggatttagatttgtcaccagccaccctatcaacccttgctcgcaggggttctggctctagtacccgtagcctattcggtggatttgttgagtggggcatgggaactggttcggaagattcgatggctcatcccattgatgatgcggattgggatatcggcatggtcgtcttggcggtcaataccggaccgaaaaagattgctagtcgagagggaatggaccacacagttgccacctcaccattttacacagcctgggtagaaaccgctaagcaagacttggtggacatcaaggcagctattgccagccgtgattttgaaaaacttggtcagattacagagcacaatggcatgaaaatgcatgcaacaacgctctctgccaatccaccctttacctattggtcagccgatagcctagtggctcaagaggcagtccgtcaggttcgtgaagcaactggcttatcagcctacatgaccatggatgcaggaccaaatgtcaaggtcctctgtcgagcaagtcagatggatgagctagtagctggattggccaaagtcttcccaagagagaaaatcatcaccagcaagcctggacctgctgcttatgttctcagtgagaaggattggcaggcatcacaaacagcatttgaaaagggaatctagcatgaaagtgcaagtaaagataccaggaaaactctttctggcaggggaatatgcagttgttgaagctggctatcctgcggtgattgcggcggttggccagtacctaaccgtcaccattgaaacaagtgaccaaggcagtcttcattctagtcaaaaggcagacctttatctgacctgggagcgtaaggaaggtgccgttcgtattcaaggtagccatccctatgccttgattgaatcagctatgcaggtgacagaagcctatctgacggccaagggctatgcttgtcatggaacctatagcctatctgtacagtccgacctagatgaccaagcctctggtgccaagtacggtctggggtcttcaggagcagtaacggttgcgacggtcaaggccctgttgacctattacggtcatcaagcggatgcccttttgacctacaagctagcagctctgacccagtccaagctaggcatgacaggttcctttggagatttggcggcttccagttttggcggcttgatagcctatcattccctggaccgttcttggcttttagggaaaatggcagagctgtctctgctggatgtggtggaaagtgattggcaaagtttgtctatcagccctatccagttaccccaaggtctagacctcttggttggttggacagggtcggcggcttcaacggatagtctagtttcccagatggaaagccaaaaaagtcagacagaaaaagagcaaattcatagccagtttttagccgactccaagacttgtgtagagcagttgatagtggcctgtcagacaaatgattcagtatcagctagacaggccttgtcagctaatcgcaagctcttacaggactttgcgagaggaatgggcttggtcattgaaacgcctcaactgagtcaactctgtgatctggcccaaacttatggagcggtggccaaatcatctggtgctggcggaggtgactgcggtatttgcttggtagacagtaaggaacaaaaagcagcgatagagacggcttggcaagaagccggtatttttccactcaccctaaacatcgcaagtagagaataaggagaaccctatgttttatctaggagaatttggtttagatcgcaaggatcaacacgttggcttggccaatcagcaatatagtgccacgccggccaaggactttacagaaactctgtttgtccatcattccctgccgcagaccaaggtggatgaagtggatatttcgaccagtgtagctggtttggactttgcctttcctttcttcatcaatgccatgactggtggaagcaagaagacccgggaaatcaaccgtctgttgggaattatggggcattttggcaagattgccctggcttctggttcggtcagtgcggcaatcaaggatccgtctgttgcggaaaccttctctgttatgcgtcgggaaaatccttacgggataatctttgccaacctaggtgcccatcatagtgtggaaaatgccaagcgggcggtggatttgttggaggccaatgccattcagatccatgtcaatgctcctcaggagattgtcatgccggagggggaccgtgatttcactatgtggttgaagaatattgaaactctggtgcgggagatggaagtgcctgtcattgtcaaggaagttggttttggcatgagccgtgaaacagtagcccagctggcttctgccggcgtgcaaacaattgatgtatctggtactgggggaacggatttcgccaagattgaaaatgcccgtcggaccttcaatgactatgcctatttagaaggttggggccagtctaccgtgacttccttggtggaagctatgtctgtttctgaagaagtttgcccaagcctgattgcttctggtggcattaaaacaccgctagatattgtcaaatcattggctttaggtgcagaccttgtcggtatgtccaatcatttccttcaatatgtcaaggatggaaaagggcatcgttttgacgacggtttgcaggctattaaggtctatcaatggcagattgctgaaatcatgaccatgctgggtgctaagaatattgcggaactccggcagaaagatctggtcttggcaccaaatgtccagaactggtgtgaggcgcgtgggattgattggaaagcctatgcccgtcggtcagcgaatgtgagttaaagagagatagattgatgtcttcagttctcaacaatgtagaaaaataaaaaagccaggtccattttggaacttggcttttgtcatggagtggtttctaggttgctgttaactggcctgcttgtaactggtacatacggtggtagtgacccttgagggctagaagttcttcatgattgcctgactcgatgatctttcccttatccaagacataaatacagtcggcatcctgaatggtcgataggcggtgggcgatggcaatggttgtccgcccttttcgcattttctcaagagaagtctggactgtcttctccgtctcagaatcgatattggcggtagcctcgtctaaaatgagaatcttaggctggctagccatggtgcgtgcaaaggccagcagttgccgttgtcctgtcgaaaaggcggagccccgctcggtgaccaagtggtcgtatttctcaggaagtttttcgatgaagggagcagcgtccacaaatcgagccgcttcctcaatctcctcctgagaaatatcctgatacatctggatattggatgcaatggttccgtgaaatagaaagggatcttgcaggactaggccaatcgcggaccgcaattcttcctgcgaaaagctacgaatatcctgaccgtcaatcaaaatccgtccagattggaattcatagaaacgcataaagacattgatgatagaagatttgcctgatcctgtagcacccacaaaggcgatggtctgcccctgtctcacttcaaaggaaaccttgtccagaatttgccgcttgccgtcataggaaaagtaaacatcctcaaagacaatatgccccttgtcaatcttggcccctcggtccagctgtagtggctcctcgatggtctggtccatgagcgtaaagacccgtccggcagataccatagaggtttggagggtggaaaaatgctgcgtgacatccagcaagggatcgaaaagacgattgacatactggatgaaagcatagataagaccagcagaaattccagcctgtgaccagtccaaaccaaaataggtcatgagtagggcataggccaaaatcttaacaagtgacagggcagggcggagaaagagactgtccaaggccatggaacgactggcatagtccagatgttcctggttgatagcctcaaactcttcctttagcctctcctcttgagaaaaggcctggataatccaaatcccctcgatgctctctgccagtttgctgttgatggcactcaacagacttctagtcttggccacaatgggagctgaccgcttccgatactgatcaaccaggatgaaaatcacgggcaggaagaggacaatcagactggtcaatttccaatccagagcaaacatggtcgaaagagtcgtgacgataataaagagagctgagataaaactggataaaatccctgaaaacatctctgaaatactctccgtatcattggtgatgcgagagacaatggaaccactaggagtctggtcgaagtaagccattcccagcttttccattctcccaaaggcatcccggcgaatatctctgacaatgctgtaggaaactttagcaaaccagagatttccaaaatattgaagtaccatttgaagcagatagagggcgaagtaggcagctagaatggccacagcagtctcagaaatagtagaaatgtagtggtcgataaaataagaggctagaaggggaattagactgcggaccacggtagtcagtagcaaaaagctcaaggcaaggactgtcagcagtcgataggctttgagataggacaagagtcgcaaaaaaacactagcttgcttggttttagagagcatcactttcctccttttcgagttgctgcatcatataggtatcgtagtaccagcctttttcatctagtaattcttggtgacgacctcgttctacgatttttccatcttcaaggaccagaatcaaatcggcatggacaatagctgacaggcgatgggcggtgataatggtggttttgtcaaggcgttcttgcttgatggtttcgagaatagcgtgttctgttttagcatccaccgctgagagcgagtcatccaagagcaggatatctggattgagaatcatggcacgggccatagccaaccgttgtttttgtccgccagaaagggaaatccccttttcgccgaccatggtttcaaagcggtcgggcatatcctgaatatcctcatagacatggacagcccgagcggcctcttctacctgatttagagataaatcgggattgccgaagcggatgttttcagtaatgctggtcgcaaagaggaactggtcctggggtacatagccaattaagcgtcgcaggtcagctagcttgtagttcttgatattttcttgattgagcaagatctgtccatttatcacatcgtattctcgcatcaggagcttgagcaggcttgttttcccagaacctgttagccccacaagaccaattgtctgcccttttttgatctgaaactggatgtcttggaggactggtatgttatcataggcaaattcgctaatctcatagacaagctctccattgcttggtgcaggcagcggttggtctgtttcaatgacctctgaggaaatgctgagaagggtctgaatccgattgtaagatacatcaccacgctggctaatattgaccaaaaaaccaatcgccataagaggccagacgaggagatctaaataggtcatgaaagttactagttggcccagactgacctgaccttgcgagatgaagtgagagccgaccagaagggtcagcaggtaggacaggccaatgaagaagaggacggcagggttgaacagggcatcgtaacgcatggttttgatattctgcaagaaggctgcttggttgacttcctgaaaagccgccgtttcttgttcttggtagccaaaggatttagtaacctttataccagaaacagcttcctggaccttgttgttaagctctgaaaaggctgcctgtgaagccttgaaattttcatgagtgcgacggcctaaaaaattagtggttagagtcatgaagggtagggggaggattgcaaccaaggtcatctgccaggaaatgctcaaactcatcgtaattagggtaaccaaggctgtgaccgttgcatcaacaaaagacatgacgccaccacctgctagtcgggtcagggcattgatatcattggttgcgtgggccattaaatccccagtccgatgttgctgaaaaaaggatggagataggtgcataaagtggtcaaacagccgagccctcatgatttttcctagacgataagatgttgccaggatgttcattcgccaaagatagcggaggccgtacatggccaaggctgacaagatgagcccagctaccccgagtagcaagcgatgctcagtcaactgtccgctggcaatctggtcaatcaactgccccatgatagaagcgggaaggagattgaggaggctgaccaaacagagtgataaaatcccaatcagataggcctttttctcaagggaaaagaaccaccacaattgcttgataatcttcataaatgtcctttctgaacaaaagaaaggttggtagcttgtcgcaaccaacaaataatagaattcggtgacactagtgtatcacagactggtagaaatagaaagtttgtaacttaaaaattaggcaactctagccgtagccgaatagaagaaacagttggagttgtaaacacgtacgatacaggtagaaatcaaaagatttttacctttttctgtctatttatgataaaatatatgaaaatttagaagaggtgttcagatgaaagctattgttacagttgtcggtaaggacaagtcaggaattgttgcgggtgttgcgaccaagattgcggagttagggctcaatatcgatgatatttcacaaactgttttggatgagtattttaccatgatggcggtggtgtcgtcagatgagaagaaagatttcaccaagcttcgtgcagaactagaagcctatggtcaggctttgaatgtgaaaatcaacattcaaagtgcagccatttttgatgctatgcacaacttgtaaggagagatttcatggatattagacaggttagagaaaccattgaaatgattgaggagcagaatttcgatattcggaccatcaccatggggatttccctcttggactgtatcgactcggatatcgacaaggctgcggagaaagtgtataccaagattgtcaccaaggccaagaacttggtagcagtcggcgatgagattgcggcagaactaggcattcccattgtcaacaaacgggtgtcagtaacgcctattgctttgattggtgcggcgacggatgccacggattaccttcccctagctcatgccttggacaaggcggctcatgagatcggcatcgattttatcggtggtttttcagctcttgctcaaaagggctaccaaaaaggtgatgaaatcctcatcaactctattccgcaggcattggcccaaacctctaaggtctgctcgtcagtcaatatcggctcgaccaagacgggtatcaatatgacggctgtgcgggacatggggcggatcattaaggagacggcggaggcttctgatatgggggctgccaagttggtggtctttgccaatgcggttgaggacaatcctttcatggcgggggccttccacggtgtcggcgaggcggatgtggtcatcaatgtcggcgtgtctgggcctggtgtggtcaagcgtgcccttgaaaaagtgcgtggtgagagctttgatgtggtggcggagaccgtcaagaagacggctttcaagattacccgtatcggtcagttggtcggcaatatggccagtgaacgcctgggggttaagttcggtatcgtggacctgtcgcttgctccaacaccagctgttggcgactcagtagcacgggttttggaggaaatgggcttagaaaccgttggtacgcacggaacgactgctgccctggctttgctcaatgacgcagtcaaaaagggtggggtcatggcctgcaaccaagtcggtggcttgtcaggtgcctttatccctgtgtctgaggatgagggcatgattgcggcggtgcaaaatggctcgctcaaccttgaaaaattggaagccatgacggctatctgttctgtaggtttggacatgattgccattccagaaacaacgcctgctgaaaccattgcggctatgattgcggatgaagcggctattggggttatcaatcagaaaacaactgcggttcgtattattccgcttggaaaagaaggagacatgattgaatttggcggccttctgggaacagctcctgttatgaaggtcaatcaagcttcgtctgtggactttatcaaccgtggtggtcagattccagcaccgattcatagctttaagaactaaaaaacgtagaccgattgccacaagcagtcggttttttgttatactaatagtaagaaatgacaaggagaaaaacgaatggcagatgtaagattatatatttctcgtcacgggaaaaccatgttcaataccattgggcgcgtgcagggctggtgtgatacgccgctgaccaaggtcggtgaggaaggaattcgtgaactgggcttggggctcaaggatgcgggccttgactttaaactagccgtatccagtgatctgggtcgaaccgttcagaccatgaccatcgcccagcgtgagttaggaattttagggaaaatcccttattaccaagacaagcgtatccgtgaatggtgtttcggtagttttgaaggcatgtacgatgccgagcttttccaaggggtcctgcctcgtttgaaagggacagttgatgcgacgggtatgtcctttgcggaaatcgcagcaggtatccaagaagcagacaccgctggctgggcggaatcgtgggaggttttgagcaaccgtatcttgacaggttttgaatccatcgcccaggacttggaaaaacaaggcggaggcaatgcccttgtggtcagccacggtatgactattgcgacattggctcatttgttagagccagagcgtggtgccaatgtctttctcgataacggctcaatcaccgtcctcaaatacgaaaatggcaagcttttaattgaagcagttggggatttatcctaccgcaaacgtggggcagagttgattgcccaagggaaataagatataaaatcagggaggattctctgattttttttcttgacatccaccattctaggtcctcagactgatttttagcactctaagcaaaagagtgctaattttttgtctttttctcttgacaatccattttttcggcgtataatgggagtataagtaattagcactcgatatcatagagtgctaacgctcttcaaaaatcaacactatccgttgtcagcttgcctttgtgaaccatagttctacattcggcctcgcttcctaggctactgtcgattttcgctgagcgtaactaaaacagtgttcatgaaaggagcggagatgattacccaacgtcaaaatgatattttgaatctgattgttgaattatttacgcgccatcatgagccagttggttctaaggccttgcaggaaatgattgcttcaagttcggctaccattcgtaatgacatggccaagctagagcagttgggtttgctggaaaaggcccacacatcaagtggtcgtatgcccagtcgggctggttttcaatactttgtcaaccactcgctcaatctgaaacacatcaatgaagaagatgtttatcaagtggttaaggcctttgactttgaagccttcaagctagaggacatcttggagcgagcaagtcaggtcctagcggatttgacaggctacacctcggtcattttagatgtggagccgaccagtcagcagctgacttcctttgacattgtgcagctcagtagccacgatgctctggcagtcttgactctggaccagtccaaacctgtcactgttcagtttgctattcctaagaacttcttgactagggatttggaagtgctcaaacgcttagttgatgagcgcttcgttgggcagacggtcttggcaatccactacaagttgcggacggagattccccaagtggtgcagcgttactttgccacgacggacaatgtcttggatctcatggactacatcttttccaatcttttccaagaatcggtctttatcagtggaaaagttgcctcgctgacctacggcaatcttgccacctaccaactcttggatagtcctcagttattggcaccagagttgcggcagggcttggctcccaaccagcagaccagcatttccgtggcggaacatagagaacctgctcttgcagatgtgacggtcattcatcatcgttttccaatcccctatcggggcatgggccagatgagtttgctcggtcctgttgacatggactaccgtaggcagatgagcttaatcaacatcatcagccgcatcctatttatgaaattaaccgattactaccgttatctaagtagtaatcattacgaagtcaattagaaggagaatgctttgtcagaagaaatcaaaaacgaagaaatcgtagaagaggttgaagcaacagaagaagttgtggagacacctgaaaaatcagaattggatttggcaaacgagcgcgctgaggaatttgaaaacaagtaccttcgtgcccacgctgaaatgcaaaatatccaacgccgtgcaaacgaagaacgccaaaccattcagcgttaccgttcgcaagacttggccaagaaaatcttgccgagcttggataacttggaacgtgcccttcaagtcgaaggcttgacagaagatgtcaaaaaaggcttggaaatggttcaagaaagcttgattcaagcccttaaagaagaaggggtggaagaagtcgcaacagatgtctttgacccaaatcttcacatggccattcaaacagtcccagccacagacgattgcccagcagaacacatcgcacaagtcttccaaaaaggctacaagctgcatgaacgcttgctgagaccggctatggtagtggtgtcggaatagtcgctctgctatttcccaaaaaagaaaacctgaccgaaatgtcattaaactaggctaaattgaacataaaaagtaaattaaaaagaggtaacacatatgtctaaaattatcggtattgacttaggtacaacaaactcagcagttgcagttcttgaaggaactgaatcaaaaatcattgcaaacccagaaggaaaccgcacaactccgtctgttgtgtctttcaaaaatggtgaaatcatcgttggtgacgcggcaaaacgccaagcggtaaccaacccagataccatcatctctatcaaatcaaaaatgggaacttctgaaaaagtttcagcaaacggtaaagaatacacaccacaagaaatctcagcaatgattcttcaatacttgaaaggttacgctgaagaatatcttggtgaaaaagtaaccaaagcggttatcactgttcctgcttacttcaacgatgcccaacgtcaagcaaccaaagacgctggtaaaatcgctggtcttgaagtagaacgtatcgtcaatgaaccaactgcagcagctcttgcttacggtttggacaagactgacaaagatgaaaaaatcttggtattcgaccttggtggcggtacattcgacgtatctatccttgaacttggtgacggtgtctttgacgtacttgcaacagcaggtgataacaagctcggtggtgacgactttgaccaaaagattatcgaccacatggtagcagagttcaagaaagaaaacggtatcgacttgtcagctgacaaaatggcccttcaacgtttgaaagatgcagctgaaaaagctaagaaagacttgtcaggcgtgacttcaactcaaatcagcttgccattcatcactgcaggtgcagcaggtccacttcacttggaaatgacattgactcgtgcgaaatttgacgaattgacttacgaccttgtagaacgtacaaaaattcctgttcgtcaagccctttcagatgcaggtctcagcctatcagaaatcgatgaagtaatccttgtcggtggttcaactcgtatcccagccgttgtggaagctgtaaaagctgaaactggtaaagagccaaacaaatctgtaaaccctgacgaagtggttgccatgggtgcggcaatccaaggtggtgtgattactggtgatgtcaaagatgttgttcttcttgacgtaacaccattgtcacttggtatcgaaacaatgggtggtgtatttacaaaactcatcgaccgtaacacaacaatcccaacttctaaatcacaagttttctcaactgcagcggacaaccagccagctgttgacatccacgtgcttcaaggtgagcgtccaatggcagcggacaacaagactcttggtcgtttccaattgacagacatccctgcagcacctcgtggtattccacaaatcgaagtaacattcgacatcgacaagaacggtatcgtttctgtaaaagccaaagaccttggtacacaaaaagaacaaactatcgttatccagtctaactcaggtttgacagatgaagaaatcgaccgcatgatgaaagatgcagaagctaacgcggaagcagataagaaacgtaaggaagaagtggaccttcgtaacgatgttgaccaagcaatctttgcgactgagaaaactcttaaggaaacagaaggcaaaggcttcgacgcagaacgtgaccaagcccaagctgctcttgatgagttgaaagcagctcaggaagctaacaacttggacgacatgaaggctaaacttgaaaacctcaacgaaaaagcccaagcccttgcagtgaaactctacgagcaagccgcagcagcacaacaagcagccgcaggccaagaaggtgcccaaacagctaacaatgcagatgatgatgtggtagatggcgagtttactgaaaagtagtactcttcgaaattcttcactaggcttcgttaactctcctcgatgaactccagttcaatcttcgtccagttgcctagcctagtcttgaatttctttgagtatctagaacaaggaaagttatcttttttccgtagttcttagcttgaactcagttctcctcttcccgagaatagaaattattagttaataaagattccaatcacagaggttgcaacccagcctctgtttttgggtaaatacccgtctaacttttacagaaaggaaagtgttcgtaactgaacacgggctactttctgagtttcgtctattatttaacgaaaggaaatgaactcgccctaaaagctgtgtgaaaaagataaatcgtctagaaaatcaggattttctgccgatttcctattttcactttgcttttaacgggcttggtatcttatatgaacaatactgaattttacgatcgtcttggtgtttctaagaatgcttcgccagacgagattaagaaggcttatcggaagctttcaaagaaataccatccagatattaacaaggatccgggtgcggaggataaatacaaggaggtccaggaggcttatgagaccttgagcgacccgcaaaaacggtctgcctatgaccagtatggtcctgctggtgctaatggaggcttcggcggaggagcaggtggctttggtggtttcgacggagcaggtttcggtggctttgaagacattttctctagtttctttggtggaggtggtgcgacgcgcaatcctaatgcacctcgtcaaggggatgatttgcaatatgcggtcaatttgaaatttgaagaagcgatttttggtgtggaacgagaagtttcctacaatcgtgaagcaacttgtcgaacctgtacaggttcaggtgccaaacctggaacaagtccggtaacctgtgggcgttgtcatggttctggagtgatcaatgtggacacccaaactccacttggaaccatgcgtcgtcaaatgacctgtgatgtctgtcatggtcgcggaaaacaaatcaaagacccatgtacaacctgtcatggaactggtcatgaaaaacaagcccatacggtaacggttaaggtgccagctggtgtggaaactggtcaacgtattcgcttggctggtcaaggtgaagctggtttcaatggaggtccatacggagatctctacgttgtcattcaggtccaaccttcagacaagtttgaacgtgaagggaccaccattcactataaactgaacctcaactttgtccaagcagcacttggagatactgttcatgtgccaacagttcacggtgatgtggatatggtcattcctgaaggtacccagactggtaagaccttccgactcaaaggaaaaggtgcaccaagtgttcgtggtggagctattggtgatcaatatgtcacagtaaatatcgtcactccgacaggtttgaatgaccgccaaaaagcagctcttaaagaatttgcggcagctggaaatattgatgtcaaaccccataaaaaaggattttttgacaaggtaaaagatgcctttgaggatttataattctaagatgagactgggcaaaaagcccaggaccactactcagagttcgtttcaacatctcagcgcagtggttgattggcagatttgttcgtgttttgcactccaaatctggcctaatcaactgtgcgggggtgggaagacgaactctttttatcttggtcgagttctttcccactcccctttctttttcagaaaaaactctgggcattttctccgacgcatcacaggctctgtgttaaaataagatatagtaatttgaaagagaacgcttacgaatgaaatcttgggttgagaatgtgaccataaagaaatacgaagatcggtctggcttgacgggtttgaaacaggagccactggtgtggactgaggtctttttgcgcgaggtcaatcgtcagtccaatacaggaattttacatttttggcccatggaccaaacggtcattctggggatgatggatagtcaggttgcccagctggacaagggcttagccagtattggtcaggcaggctacagtcctattattcggagtttgggcggtttggcagtcgttgcagatgaagggattttaaatgtcactctgattttgtccaatccttctggtcacaaggttgatttgcgggagtcttatcaggtcatggtggatttgattgcccaggcactttcagattttccctttgaggttgtcagtggtgaggtggcaacttcctactgtccagggacctacgaccttagtatcaaggggcggaagtttgctggattggcccagcggatttaccaagaggctattgccatttctgcctatatcagtgtgtcaggtaatcaagtcaaacgtgggcaagtggtggcggatttttatgtggcaagttttgctccgcaagaagtatcggacagatttccgcaagtaaatccggattcgatggccaatctgtcagacttggtcggtcaggatgtgacggtggaggatatgaagaaacggattgagcaagtattggttgaaaatgggaccaggctgtctactttttatccctcgtcggacaacatggctgattttatgacctttggaaagaccatcaagcagtctatggaaaaatatggtatctaggagattcttatgatatggaaagatgcgacagccatggctcaggctgtcaatcaaaaacaggtttttgccaaggaattggtgcaagaaacgattgacaggattgaaaagctcaatcccaccctcaatgcggttgtcagcaagcagtatgaagaagccttgaaagaagcggagaaagaagactatctgggcaagccatttgctggagttcctttcttgttgaaggatctggggcaaaatgaaaaggggcagccatcttctgctggttctcgcctacttgctggtcgaccagcaggccataccgacacctatgtccaacgcttgaaagatttgggtttcatcatagtcggtcgaaccaatacgccagaattcggcttcaaaaatatctcagacgccagcctgcatggtcctgtcaatcttcccttggaccccagtcgcaatgctggtggatcaagtggtggtgcagctgcagcactggcttcaggcatggtctctattgctgcagcatcggatggtggtgggtctattcgcatcccagcctccttcaatggcttgatcgggctcaaaaccagtcgtggtcggattccagttggacctaagtcttatcgtggctggcagggagcatctgtcaattttgccctgaccaagtctgtccgtgacacccagcgtctgctctatcattttcaggactaccagctggaagctccttttccccttgccaagctgagtgaagaggaggtttttggaaaattgtctcgccccctaaaaatcgcctactataccaaatctccagtagggagcaaggtcagtcttgaagcggtagaagcggttcaaaaagcctgtcatcacttggcaaatttggggcatgaagtggtggaattaacagaatatcctctggatggagtggccctgatgaaatccttctacctgatgaacagcgtggacacggcccagatgtttgacgaaatcgaagcagcttttgggcgccagatgaccttggatgacatggaagtcatgtcctgggctatttaccaaagcgggcaaactattccagccaaattgtactccaaggccctattggactgggaccagtttggagccagcatggcgcgtttccatgaggaatacgacttgctcctgacgccgacagtggctgatgtagcgcccaagcatggacaatttgacctaccagtagatttgctggatcgcctcaagcagacccagaactattccatggaagagcagcaggacctgatctggcaaatgttcgaggacagtctggccttaactccctttacgcagcaggccaatatttgtggtcagccagctatttctctgccaacttatgtacgtgctgacagcctgccaatcggcgttcaattgacagcatccaagggacgagaggatttgctcttgcagttggcagatcaaatggaggcagctggtttactcaacttgtaagggaattcattttttcagttcaattatttgccaaaacgttttcaaaatgttaacctgtaaaagttggtgggttaacaccgaaaaagtaaaaaaggaagctatggcttccaaaggagattgttttatgttgaaaaaagttttagcctcagctctcttggtttctacattgaccttggcagcatgttctagttcaagttcgaatactagcagttcttctgctgaacagactcaatgggaaaaaattcaagaagctggtgtcttgaaagttgctacaccaggtaccctcttcccaacttcttactacaatgatgctaaagaattggtcggatatgaaattgacatgatcaatgaaattggtaagcgtttgaaactggaaattgaataccaagaaatcggtgtggcagaagcctttacagcggttgacagtggtaaggtagatatttctgttaacaactttgacatgacagaagcacgtaaggaaaagtacaacttctctatcccttacaagtattcagttggtggctacattgttcgtgaagatggttcatcaggaatcgaagcagctgacttgagcgactggactggcaagaaagctggtggtggcgctggtactcagtacatgaaaatcgctgaaaagcaaggtgcagagccagttatctatgacaatgtaaccaacgatgtctatttgcgtgatgtatctacaggtcgtacagacttcattccaaatgattactatacacaagtgatggctatcaaatgggcaaatgccaacttcccagacatcaaggtaaaaatgggtgaggctaaatacaacccaactgaacaaggtattgttatgagcaaggctgacacaagcttgaaagaaaaaattgacgaagcacttgaagcgatgaaagctgatggaactttgaaggcaatttctgagaaatactatgcaggacaagacttgacagtccctgttgaaaatgctgataaattgccagttatcgaagttgaataagacctcgtaacaaattaaatgcatcttgtatagactttgtcagtcacagactggcaaggtctatctggtttttaggaaagaggagaagatatggatattaactggcaggcagtttttaatgcagatattgcaagagaggctattccacagattttggagggacttccctacactctatccctatccctaattggttttgccttggggactttctgtggattttttgtagccctcatgcggatgtctaagtttggacccttgcgttggttggctatggcccatatttctctcatgcgtggaattcccctcatggttcttctctttttcatctattttggattgcctttcatggggctacaactagatgctatctccgcatctattatcgcctttacctccatgtccagtgcctacatttctgaaattattcgtgcatctctttcggccattgataagggacaatgggaggcagcgcgttccctgggcttgcggaccaatgtgattcacagaaaaatcattattccccaagcctttcggattgctcttccaccactgagcaatgttctcttggatatggtgaaaagtacgtccttgaccgctatgattactgtaccagagattttcaataaggcaaaaatagtcggtggagctaagtcggattatatgacggtttatatctgtgtagccctcatttattgggttatctgtaccctttatgcatttggtcagctcaagctagaaaaacgcttggcgacttactaaaaagaggttggtttagccttccgattaaaatttgaacaatcaaaaatagcttagaattaacgtctcgaatgatgtggacctaagctattttttattttaaagactgttttttcgatgtaactctcactcttccacatattccaaaatatcccctggttggcagtctaagatgcggcagatgctcatcagggtattaaaacgaatgccttttgccttgcctgtcttgagaatggacagattggcttcggtgatgccgacttgctccgccaagtccttggaagtcatttgtcggtctttgaggaccttgtctaagtttacgcgaatcatttccatatcagataaactcgctgttctcggtttcaagttgttgccccttttgtactaaggtccagacaaaataagtcaagaagataaagagggcgttgaggatgaaatctgaccaacgcagattgaggaagttgtttggtccagcagcatttgtcaaggtgatcaagctggttaggcaaaattgcccagcagtcaggacgagcaaactgatgaagagcttctgataaagttccatactagctgaagcgaaataatcttcttccagaagcaatttacataacttttgaatcaagtgggcaatgtgactgagtgctactaagacaactagaatcaatccagtcgctagcagaatgagccagacactgatctggtcaatgggtttgttaaaggtgtattcccaagagcctatcgcaaaggagtcgcctccaagaccagccaggctaaagaaaatatagcttgcaattaataaatagaagaaatagcgaacacaagcagccacaatgccagctgttttgagtagattggttttcatagcaaacctccgattattattgttttatgataatattatctgtaaaattattataaaacaataatttttgaaatgcaagcgtttttttaaaaaaagaataataagaaaaccgccaactacctggcggtttgaagctatttaaaatacaatagtctcaacccattcaaaatcaccaaaatcgttgatccttcgtggcccaccacaccgagtgggaggttgatagactggaagaggttggagatgataagaagggcaatgacagatagcgcaaagatgatgttctgcttgatgatgccccgcattttcttagagagacgaatggagtaaggaattctcgtcaggtcttccatgagtacgatgtcagctgactccatagcgatgtccgttccgcttcccatagcatagctgacattggcttgagccagggcgggagcgtcgttgatgccgtctccgaccatgccgacagacgcaaactcggtttgtaattcttggataacagcagccttatccgtcggcagacagttggcaatcacacggtcaataccgacctgactcgccacgtaacgagccgtcttttcttggtcacccgtcaagagaattggcgtcacgcccatttctttcaactgggcaatcagctgcttgctctcaggtttcaaactatcttccaccatgaagatcgccaccagcacatcattttggctgacatagaccagggttttcccagtgctttccgcctcatcgatctgtgccagcaagccagcagacaggggactcaccaggctgtccgccacaaatcccgccttaccgattttccagctgtcgccctcatagcctgccaccaagccttttcctgtcacgtcttctaggctttgaagggcaatagcagagctgtcagccgtataggtcatgagagcctgagcgattgggtggcttgattgtttttcaactgcctgaacaacctgcttgataagctcttcatcgccaagataggtcgcacctacaacttcaggtttaccaatggtcagggtacccgtcttatcaaagacgatggcctctagattggcgatgttgtccgcaatgtcaccgcccttgataatcatgcccttacgtgccgcacggctgatggcagaaagtgttgcgggtgaagaagaagctacgagggcacaaggagaagcgatggttaagagaatcatgcctcggtagaaggcagttaaccagtcccagcccagtgcaaaatgagcaaggaggatgaagagtggtaccaccaccaagacaaccttgacataggtatcttccatattttcaatgaaagtcgctgtttttgatttggattcttgggcgttttcaaccatctggacgattttatcgaagagggcatcgcctttttcagccgtaacttgtacggtcacagttggaccttggttaatggttccgccgataacagcatcgccagccattttctccgcagggagcggctcgcctgtaatcatggattcgtcaaagatggattgcggactgatgagggtagcatccagtggaaccgtgtcacccttgcggacttgcaggaggtcgccaatgcggatggctgcggtgtctaagacagtaatgtcaccattttcctcgattttgcgagctgttggaggggtcatgttcatcaaagcagcgatcgcattcttgctttttttcatggctaattcttccagagtagaagaaagggagaagatgaagatgagtagagccccctccatccagtagccaattagaccagagccgatagcagctaaaatcatgagcaggtcgacagacaggtgcttgtcgaaaatcagctcagaaatgccttccttggctgattggtagcccccgatgacaaaggctgaaatgaagaggataggagcccatccctgtccagtctgaaacagaaggatacctattagaatgagcgccaagcaaagagcggtcgtgatgatgtggctgtgttgtttgaggttggttacgagtgtcatagtttgctcttccttatttagaattattatcatttaactaagttaattataacaattataaaaagaaagtcaagttatttataataattctaaataatatcattctgataattcaaagggaaataaaaaaaagcgacagaaagccgctttgatattcgtcttttagttctggcaatcaggacaaatgccgtagatggatagcacctcttttgtaattttgtaaccagtttgggtatgagcttccttcttcaagctcgggatttctacatccatgaaatcagtgatttttccacagacttcacaaataacattgaggtgctcgtgccccataaagtcgtaataagtagtattatcattggtccgtttcaatttggtcacgaacccttcttccaatagaagtttgaggttgttgtaaacagtcgccagactcatgttggggtagttaggtattagatcttgataaatcatttcagcactagggtggtcatcgctttcgataatgtaggcaacgactgcttttctagtttcggtaatgcgtatacccttttcttttagatgttggatgacgtgttcaaaagcagtttggttttctgcattgaagtgagaatggagttccatagtttcctcctttcgttattattttataaaaattctaagatacaatattcagtttcattatagtgtatttgggaggttgtgtcaattttgagacaggaaatctgtcatagtacagtttggtgtctcatgacttgtttacatacttttcctgtgctacaatcaaaacatgacaagatataaggcaattatttcctacgacggacatgacttttctggttttcagcgccagccccatgctcgtacggttcaggaagaaatcgaaaaaacgttagtaagattgaatagtggtcagccagtaaccgttcatggtgcaggtcgtacagatgcgggggtccacgcttacggtcaggttatacactttgacttggctggcagtcgagatgtggagaagctccgctttgccctggatacccaaacctctgaggatattgatgtggtcagtgtggagcaggtggcggatgattttcattgccgctatgccaagcacagcaagacctatgagtttctggtggatattgggcgacctaagaatcccatgatgcgccactatgcgaccttctatccctatgatttggacttgagcttgatagaagaagccattcaggacctagtgggaacccatgatttcacaggctttacggcttcggggacctcggtcgaggacaaggtgcggaccattacagtagcaagtatggaatatgaccagcagcggcagttcttgattttcaccttttcgggcaacggttttttgtacaagcaggtgcggaatatggtcgggaccctcttgaaaattggcaatggtcgcatgcctgttgggcagattaaaaggattttagcagaaaaggatcgtggtttggcgggtccgactgcggcaggcaacggcctctatctaaaggagattatctatgaagactaagtatattttggcgctttctggcaacgatattttcagcggtggcgggctccacgcagatctgaccacctacacagtccatgggctgcatggctttgtggcggtgacctgcttgacagctatgacggaaaaaggttttgaggtcattccgacggagactgcggtctttgcccagcagctggctagtttgaaggatgtgcccttttctgcgattaagattggcttgcttccctctgtggaaatagcagagcaggctttggagtttatcaagactcaccaggagattcctgtggtcttggatccagtcttggtctgcaaggaaacgcacgataccgaggtcagtcagttgcgagatgaaatcttgaaattccttccttatgtcagcattatcacgccaaatctggcagaagctcagctattgctccaaaaggatatcaaaacggtggaagagatgaagcaggtggcagtggccttgtatgacttgggagccaaggcggtggtcatcaagggaggcaatcgtctgggtggctcagaggcggttgatgttttctacgacggtcaggaagtggtggtgctccagtcgcctctgctgtcagaaaacaatgtgggggcaggctgtacctttgcgtccagcattgccagtcagcttttgctgggtcaagagcctttggaggcggtcaggctgtccaaggactttgtccatgcggcgattgaaaaatcagatgattatggggtggttcaatatgagaaataaacaaacgcaagaattggtcttgctcgctatcttaacagccttgagtttggtattagcctttgttcatgtaccaactgcaactggttttgtcacactcttggatgttggggtatattttacagccttttacttgggcaagaaagagggagccattgtcggcggattgtcagggcttctgattgatttcttgttgggctatccccagtgggcattctttagtctagtattccacggggctcagggttattttgcgggttggacaggtaagaaacggattctcggtttagtcttggcgaccctctctatggttgggggctactacctggcatctcgactttattttaatgacctgaaagccattgaaagtgttctaagcaataccttgcaaaacacagttggtttggtagttggttacgtcttggctcaggcaatagaaagaattggtgcagtaaatcatgttattaagggaaattaaagaccaaactaagcaagttgtgcaagaagtcctagaactcagcgatcttcaaaaaggacagatatttgtccttggattgtcctctagtgaggtgattggagggcatatcgggaaaaattccagtctggaagttggtgaggtggttgttgaaaccatcttggaaattctggatcaaaaaggtatctatctagctgtccaaggctgtgaacacctcaatcgtgccttggtggtggagcgtgaattagcaatccagaaggacttggaaatagtcaatgtcttacccacccttcatgcaggtggttcaggacagctggcggccttcaagtatatgaaggacccggtggaagtcgagtttatcaccgctcaggctggtgtagacatcggcgacacagctatcggcatgcacatcaagcacgtccaagttccgattagacctagcctgcgtgaaattggacaggcccatgtcacagctctcgccagccgaccaaaactaatcggcggagtccgagcagcctatcaggaagatgagatacggaaaggttcataatgaaagaatttacggttaaggatttagtgtggacccgtccaccgagacaattcactatttcagatgaagaaattaccattaccacccacccccagacggatttgtggcagaagacctattaccattttgtgaatgacaatgctcctgtcttacagatggagacagaggaggactatttttcttttactgtgaagacggattttgcgggtagtcatactcgatttgaccagtgtggaattgtcctttatcaagattcggagaattggctcaaatgttcgatagagtatgaaaatgatgacttccaacacttgggaagtgtggtgactaatcacggcttttctgactgggcaactactgaagtcagttcacaaatcaaatccatgtggtttaggctcagtcgcaggggagctgattactgttttgaaaattccgaagatggtatccacttcaaacaaatgcgggtttgccattttcatcaaggggcggggaaaatagcttttgggctatatgcctgttcaccagaaaactccagttttacagctcgctttaccaatatggaattgagcgactgcaaatggcaggcccatgatggccaagagccagatgaaatatagtgagagttttaggtaagtagtaacagaaaaatagttgaaactcatactcttcgaaaatcaaaatgttccgttgtcaacttgccttgaagaactcctgttcaatcttcaccttcgtttcctaggctacttttgattttcattgagtatcaggaagtaactttcgactagtaagagagttactttttttatcttttgagccaaatccttgccaaaaaagtctggcttttgataaacttgtttctgtaaatgatacaagaacaaaaggagaagacatgacaaaaggataccaacaacgattttcactgtccattttattatggatgcgtcaggataaagcacgccaagagggaatggactactggagtggcgggcatgcacagattattgcagcttcaccgggtctattagaataccgccagcaacatttgagtgagacagaacatagtttttggccgaaagcgacaggcttggaaacggctgttccagaagatcgtcggattgatggcattgcggaagtgacctatcaaaagttattggcaccaataggcggtcgccgtcagacggccctggcctttgaagatgaggtcaatgttttccgtcggactttgatgcacatgggcttcccttattcatcacgttggtaccatactagcactcaggcccaaacccaactgcgtgatgtcctatacttccgtcgcaaagatggggtgaagagcggtagcttcaaaaaatttgttcaagatggactcgccagtcaactggcgacaatctctggggtaacggaagtacgaacacaggtctatcttccttggaataaagcgacttggaataccccaaatgttgcccatgacaatcctaaagaagaccatcttcatgcctccatcatcccaggttttgcggatcaggcggcaagagaggccttctatgccaaccaggctccgcagttgaatgcagaagtggtgcaatactcctcagcagtccacgcttatcatatagaaaaaaccttgccatttgtcctagacggcaaacgcatgtaagacaagcgacttcttggtcgaatgctttgttaaaaaaatatagtcgaatgaattagctttcagacaaggaaccgaggtgcaggttgctagcacagcctagtggctgtgctaggttggagatataacttgcaaagcaagtcacttctgcagagtacggcaagccgaaagtgacgatgtatcaaagttaattcaaatgactataaagcaaaagacttgccaagaagtctagcttatggtaaacttgttcttgtaaatgatacaagaacagaaaggaaaccagatggatacaaagttttcagtagcccttcatatactgaccatgatcagtgagagtaaggaaatacttagctcgcaagccttagctgagagcgttggcaccaatgccagctacatccgcaaggtgattgcacttttgaaaaatgcaggcttaatcacttcgcaccaaggccgttcaggctaccaattgagcaagtctcctaaggatattagcttattggaaatctaccttgcgacgcaagaagtggagcatattcgcctatttcagatacaccagaatgccaatctttcttgtccggttgggcagcatatagaaggcgcaatggttcccatcttttccagcgttgaacaagaactggaaaatcaactcagtcgtcaatccttagataatgtgattactaatctctatcaatccgcacaagtaacccgaatctgacctcggtcagattttataaactcaaacatagacctgtaagtgatacaggaacaaatgatataatagaaaagagaagaacatgaaagcagcacaacacacatcttataacaaaaacaacatcgcccttaaccttacagaaattgctaagccacaaatcaagcctaaccaagtccttgtcaaagtgaccgcagcaggcgttaaccccttggacaacatgatttcacgcggagatgtgaaattgattgtcccttacaaattgccccaaacagctggaaatgaagtggttggcttggttgaagaagtaggttcaagcgtgacgacctttgcagcaggggatcgtgtcttcggtcgtcttccgcttgatagtatcggtgcttttgctgagtatgtagcggttgacgctcaggctcttgctaaggttcctgcctacttgacagatgaagaagcagctgccgttcctctgacagctctgaccatcatgcaggcacttgaccttatgggggcacaatctggcaagaccatcttcatctcaggcggaactggtggtgtcggaggtatggccattccgattgccaaagccaagggcttgaccgttatcacaaatggtgatggggcaagtgcagagcgggtgttgtcattgggtgcagaccgttttatcgactacaagacagaagattacaccaaaacacttagcgatgttgactacgtcttggacacacttggtggtgcagaaacagagaaacaaatgtcaatcatgaaaaaaggtggacagctggtttcccttcgcgccatgccaaatggcgaatttgccaaacgtatgaatttgccaaaatggaaacaaatcttgtttggcctagctggtcgttcatttgacaaaatggcaaaaaaatacggtgttcactaccatttcattttcgtagagagcaatggtcgccaactgcaagaagtagcagacattttcaacaagctcgaaatcaaaccgtcaatcgatacagtttatccatttgaagaagtcaacgcagcacttgataaggttgccaacggtcgttcacgcggaaaaacagtcctcagtttcaactaaaaaataaaatatacagggaaaaatcatgtcatatattacaaccaaaaaccaatacatcaccgtttcaaacaataaaatcgcctatcgtgagctcagcaagggcaagtctgacattcctttggtcatgctggtccacctagcggccaccttggacaactgggatcccaaattgctggatttgctggctgaaaagcaccatgtaattatcctagaccttcctggcgtaggagctagtcaaggcaaggtggctccgactattccaggaatggctgagcaggctgttgctattatcaaggctttgggtcatgagaaaatcaatttgctgggtctgtctatgggtggttttattgctcaagaaatcgttcgtctggatagtcagctggtcaaccgattgattttagcaggtacaggtcctcgtggtggttttgaagttgataaggtaactggaaaaaccttccgctatatgctgaaggctggtttagagcgtgtggatccaaaacgctacattttctacaatcatgatgaagcaggtcgtttggaggcagaaaaagtcttgggtcgtatggggcaaagaagtgctgcacatgcagacaaggacatgaatgttccaggatttttgacccagctgaaagctatcaaacgctggggaagagagccgcaagatgacatgacctttattacccaaccaactctgatcgtcaacggtgataaggatatgcaagttccgacagaaaattcttataccatgcatgaaaaaatcaaaaatagccaactgattatttatccaaatgcaggacacggctcgatcttccaaaatgcagaagagttttcaaaagccttactagcctttttggaggaaagcaatgcctaaaactattttaatcacaggatcgacagacgggattggcaaacacctagccatgaaactagctagtgaaggccatgaagtgattttgcacgggagaaatagcgaaaagctccgtgtagctctcagtgacattcagctaaaaacaggaagtaaaaaaattcatggctaccttgcagacttttccaagttagcagatgtctatcgtttcagccaagaaattaaacgcgattttgagcagattgatgtcttgttaaacaatgcgggtgcttactttggtgatgcgcgtgtagcaacggcagaaaatatcgagatgacctttatgctgtctgtccaagttccgtatatcttgacgacggagttacttcccttgctggaaaaagcagcaggcagggtcattcatacctcttccttgatgcaccattttgcacaaaccagaggcttggattttggtttagagcagagctattctgcagccatggcttacaataatgccaagctttacaccatttggctggcaatagctcaggcagaggccttagaaaagcaaggttcatctgtgaccgtcaatgcctaccatcctggcttgattgcgacaaatttgggcaatgatggtatcaaacgcaatctgagaagtcggattctcaccagtctgatgaaaccattttccaaggatttggaccaggggattgaaacgggttactacttaagcttgtcaccagaggtggctggagtatcaggtcgttattttgcggagaaaaggttggctaatgtcagcttgaaaggatttgatttggcaaagagccaagccttactagcctatcttgataagaaaattcaagtatttaaggagagctacggtgactaagattttgttagaaaacctccaactgcccaatggtcaggtcttagacaatcgctttttcaaatccgctatgagcgaaaccctggcagatagtcagggagctccctcagatgacctgattgccttatatgatttttgggccaagcagggagtgggtgtcttagtgacaggcaatgtcatggtggacggccgctaccttggtgagccgggcaatgtggtccttgattcagacgctcatctggctcaatttcggaaatgggcagccgttgggaaaaagaacggtgtgcctatctggctccagctcaatcatcctggcaaacagatgtatcggtcgatcaatcaaactccgattgcacccagtgccattccgatttctggaggttcagcttcggcctttcgtccaccgagagaaatgactgtgtttgacatcaaagaagccagagataaatttattgcagcaggccttagggcaaaagcagcaggatttacaggtgtacagttacacgctgcacatggttacttgaccaatcaattcctctcaccagcggataatcagcggacggaccgctatggtggcagtctggacaatcgcatgcaattcttggtggaagtttatcaaggtctgcgtgaaaaagtgggaccagattttaccattgccttgaaattgaatgcttctgattttaaggaagagggttttggttttgaggattgtaagcatgtggtgaaaatcatgtctgacttgggtattgacctgattgaaatttcaggtggcaattatgagacacctgtttttggtagtgactatgagaatggtgctggatttgtcacctatgcccttgctctagcagatttgacttctgtttctattgtttcaacaggcggtttccgaaaagtcactcagatggaggaggctatcaaggatggtgtgtccatgattggtcttgctagaccctttgtccttcgtccaagtcttgtcaatgattaccgtcaagtcggtgatttgcaagcagacggcgaacggacaggtcgttatattcttggcggtgaagagttggtcttgaacagcaagggagaaagcgttatttcctatgcagattatgccattggtatgattgacgagattgcaacaggtgatcatctcaaagcacgtatcagccttgtcagtgagtaaaagattgttatgcagatttcaaataaatttaccattgccattcatgccttggcttttatccatctctttcaagaccagcaacgtgtcaccagcaaggttttggcaaacagtattcaagccaatcccgttatcattcgctcggttctatctggtttgaaggaagcgggaattgtagatgccaagcagggtagcggcggttttcgtttagcaaagacgcttgatgacattagtctttatgacatctttgttacggttgacaatattgataagaaaggcttgttcaactttcatgaaaatccccatcccgactgtatcgtggggggaaatatccatgctgctgtggacgacaaactcgtccaagtccagacagctatggagaaagaattgaaaactatgtatatgtccgatgttctggttgacctagaaaaagccattgaagaaaaagtgaaaaggacttaaatgggagtgggaaagaactcgaccattcatagaagagttcgtcttcccacccccgcacagttgattaggtcagatttggagtgtaaaacacgaacaaatctgccaatcaaccactgcgctgagatgttgacacgaactctaagtagtggtcctgggctttttgcccatcctcactatacacaaaaagacttagagtgactgaacatcagttgtctaagtctttttgcttggtttggtcaagaacgttgacaagcttgctctattgctcactcatcaaccgcatgatgtcatcagggctttccttacagcctcgagcaacccaggttttgagcactcggaaaaatcctcctacgataaattgcaggtgaaaatcatcagtcaagtcccccagtttttctttgaaatagcgatccaagacctcctcgagcaagtagtccaaatggttggcagtcaataagcgaatcttatcctgttgctcataccaaaagtcaaaaaattgccgtaaagctagtaagagatgagcatctgaccaatccgacaagtcaatctgccgttcggtcaaccaggcttgcgattccaagttgaaggatcgttcgagcacctcttccttattggaaaagtttcggtaaaaggtcacccgaccgatgccagctcgctccaccaactctgacacactaatcttttcaaaagatttgtcttccagtaactcccacagagcctccacgacactctccacaaataatgactctttccgcttcactctttccatgcgaaacacttcctttcctttgtttccttttggggaaatagcagagctgggactagttttcccactgtccatctgctatactgataaaaacgaaacacttgtttctaaaaatataccataaaggacagaaaaaagaaagtatgaaaaaagttttaatcggcattgggattttaatagcttgttttggtattggtttcctgtatttagccagcaagccatcagtggcttctaactacacagaagtagttgaaacgggtggagctgttgagaaaaagtatcttggacagggcaactatgacgtttcctatctcgaaatcaatgctttacaaaatttcaaaaaatatgaactgtactatcctacaaatattgaaacagaaaccagaaaatttccagtagtgatattttctaatggtaccggtgttagagcttctaagtatgcgtctgttttgaaacatttggcttcttggggctttattgtcattggtactgaggaagaatattcttggaatggattttcatccgaaatgagcttgcgacttgctatcaagctaaatgataataagactgttgaaggcctaaaatcaaatcctttctttagtaaagtcgatttagataagatcggcctatcggggcattctcaaggaggagttggggtctttaatgctgttacggaacaaaagcatgggcatatgatcaaaactatttacgcggcaagtcctgccaatttagaactttctagtaatttagaatgggactatgacccgagcttgatttctgttccgacctttctagtatcgggtacgggaggtggatatgaggatttggtagtgtctggcaagcagttgacacagatttatgagacattaccagctaccatcacgaaggtaatggctcggagaaaagaagcaggacatggtgatatgcttagacttccaaacggctatatggtagcttggtttatgtggcggttacaaggagcccctgaagcagagacggcatttcaaggaaactccccagaaattgttcaaaacaaactctatcaagatcaaagaataatgaactaggatttgtatcattgacggtcaaaagcgagttctgtctttctattgtttgttcttgttttatgttagtagcttattcaaaaaatgtgtaaaaagagtgtaattcttcatgaaaaaattcaaaaaaatcatcttatggacccttgggattgtagccagtctcggtatcattgcttatgtgtctgttaccaatcatccgcagttggtagtcggtgtcattcaatcgtttatgtacaaagagagttcaccgaactcttacagtcctctttatgatcccattgatggtctgaaagaaaatggtcagtatttgaaaagtgagattgcctatagtaaggactatcccaacagttttttagatattacctatccagaccaaaatcttgaagctgaccgaccaaccctcttctatttccacggtggtggattctttggaggtagcaaaaatatgggggcccctctgtcagctagccaagcgacctacctcattgatgacatcgtgtcaaaaggatataatgttgtcaatgtggattatgctcttgtaccagaccaccatttcccaacgccagtgattcaaatgaatcaggctatcgcctacatgaaggaacacgctgaagaatatcacttgaacatggacaatgtcgtcttgatgggttcatcagcaggtgccatcatggcggcacaatatggtagcgtcttagccaatcaagagtacgctcagctattgaatattgaaccaagtattgcaaaagaagatgtcaaggctctggttatagacgatgctcctttagattatgccaaatttagcctaggtacgaagatcttggttggaaattatgtttcagaaaccatctatctaagtgaggaagaaatcaatgcctataaccctatttcccatgtgaataaagactacccagctagtttccttctgggaagcgaggatcgaacagatatggtgtcgctcaacaaggctttgaagcaagcgggagttgaaaatgaattggtcgatcctttggcagaagaagggcttgaaaagcctcatggttttgtggcgaatttacgaacagaccctgtgtctgccaaagcatttgaacggttgatgatttttatagacgatagaaccaaggaatagtcggagtgttgataagttggaaactgatagggatttgtccaatcaatctgtcgctctgacaaccatgtttgtactcagaaagtctacgccgaaaaattccaagtgagaacaataagtcccagctctgccatttcccaaaagtacgttataaaatcgttgaaatccttgtcaattgtgttataatgaagagtatgcaataaaattttaaggagaatgacagaatgtctgtatcatttgaagcaaaagaaacaaatcgcggcgttttgactttcacaatcggtcaagatgctatcaaaccagaattggatcgcgttttcaacaaagttaagaaagatatcaatcttccaggtttccgtaaaggtcacttgccacgtgccgttttcaaccaaaaatttggtgaagaagcactttatcaagatgttgtaaatgcattgttaccagcagcttatgaagcagcggttgcagaagctggtcttgaagtcgttgcacaaccaaaaatcgacgttgtatctatggaaaaaggtcaagactggacaatcactgcggaagttgtgacaaaacctgaagtaaaattgggtgactacaaaaacttggcagtttcagtagaagctactaaagaagtaacagacgaagaagttgacgcaaaaatcgaagctgcacgcaacaacttggctgaattggttatcaaagaaggtccagcagctgaaggcgatacagttgttatcgactttgtaggttcaatcgacggtgttgaatttgacggcggtaaaggtgagaacttctcacttggacttggttcaggtcaattcatcccaggttttgaagcgcaattggttggtcacgcagctggtgaagaagtaaacgttgaagtgactttcccagaagactaccaagcagctgaccttgctggtaaacaagccctcttcgtaacaaaaatccatgaagtaaaagcaaaagaagttccagctttggatgacgaattggcaaaagacatcgacgaagaagtggaaacacttgatgagttgaaagctaaataccgcaaagaattggaagcatcaaaagaagttgcctttgacgatgcagttgaatcagcagctcttgaattggctgtagaaaacgctgaaatcgttgaattgccagaagaaatgattcatgaagaagttcaccgtgcaatcaatgaattcttgggtggtatgcaacaacaaggtatctcaccagatatgtacttccaaatcactggtacaactcgtgaagaccttcataaacaatacgaagcagatgctgaaaaacgtactaagacaaacttggttgttgaagcagtagctaaagcagaaggtttcgaagcaactgaagaagaaatcaacaaagaaatcgaagacttggcagcaacttacaatatggaagtggcacaagttcgtagcttgctttcaccagaaatgcttaaacacgacatcgctgtgaagaaagctgtagaagtgattacaagcactgcaactgtaaaataattatttggaaaactcgactctggtcgggttttttgtttaatcatctttcgatgttacaaagaaactctctgaaaaaccttgtccgtcccatgcagaaatgggagaatgtcatatctgttggtggagtcgtccaagtttcacaaggggtacgaataactgacggagaggtcagccattaccagttgccgtggtcggtgctcccatgtttacaagctatcgaatatgactgttcttttttagggagtagaattttattggactatttgcaatccaatctcatcatatcaggtgcctttgggttattttacaaggagtatgtcatagcagttgggggttatgataggcagacactgggagaagatatggagctagtcatgaaattgcattatttctgtagaaataacaatattccttatcgaatctgctatgaaaccagcgccatttgttggagtcaagcaccgagctctatcggtgatttatgcaaacaacgccgtcgctggttcttgggactctatcaatgtctaaaaaaataccgaaaaatgttatcgcgagttcgttttggggcggtgggatatttttcctatgcttactatatgctatttgaatttttggctccgtttatagagactttcggttgtttcgtgattctactttcgttgatctatcatcaactaaacatctcatttttcatatcgctctttttcctccatagtgctttttgctcactaatcacctttgcgtcatttttgcaacgcgtctactcgcaagatttatttattggacctatggatttgtgtaaagccttcctggcaaccttgtttagatattttttcttgcattgggtattgaatattgtccgtctgacaagttttattggatataaaaagagaaagcgtgaatggggagaaatcaaacgagtgaaacaattcgtttaagtaaaggtaagactggcttataaaaagaaagtcttatctttttttaaaaaatacttgactggttaatattcttgtgttatagttaactggttaacaaaggaggaagttatgttaaagaaagtgataagaggctgttttgttgccttattcggttttgttttagcagcttgctcggctcagaaggaagcgagtcaagtacagccaggaatgaaaatagtcacctcattttacccgatttattcactggttaaggaagtgtcagggaataaaaatgatgttcgaatgattggctcaagacagggcatacactcttatgaaccatcggctgcggacataaaggccatatacgatgcagatgtttttatctatcattcgcgaattttggaatcctgggcaggacgtttggaacctaatttgcaaggttcatctgtcaaggttttggaggcttcgacaaatttaccgctgacaaaggttccagggttagaagacatggaagctggtcaagggattgatgaagctagtttatatgacccccacacatggctggatccagttttggttggtcaggaagctgttgcgattggtgaacttttagcagaaagtgatcctaagaatgcggattattatcgtcaaaatgccgcaactttagagggaaaggcgcaaaagttggcagacaagtatagcccaatctttttaaaagccacatcaaaaacatttgtcactcaacacacagccttctcttacactgcgcaacgcttcgggttgaagcagttggggatcgcaggagtttcagaggaagaaccaagtcctagacagttggcggaaattaaagaatttgttgacacctacaatgtgcaaacaatttttacagaaaaaggtgcctcggataagcttgccaaggcattggcgagttcgacaggtgtagatttaaaagtgttggatcctcttgaagcagatccagaaaataatttaacctatctagaaaatctagagcaagtcttagaaacattagctcaagagttaaaataaaaggccgaattctatcgaccgaaaggagaaaaaatgaagaaaaaagcagttgttggctccgtagccgcccttgttttagggatgagtctctgtagctatcagcttggacgtttccaagcgatggaagagcaaaaaaatcgtgtgtcctatattgaagatagtcaaagtgtgcaaactaccgttgctgaacaattaacacctgatcaagtttctgccaaggaaaatattgacgctgagcagatagtcgttaaaattactgatcaaggctatgtgacatcacacggtgaccatttccactactataatggtaaagtcccctttgatgcgatttttagtgaagagttggtcatgaaggacccaaactatgtcttacaagacagtcacatcattaatgaagtccaggatggctacgtcataaaagttgatgggaaatactatctctatctaaaagaccctagcaaacataaaaatgttcgtagcaaagaagaagtggagcggcaaaaaggaatctcttctgctgacagcaaaaatcaggcagcaggaaatagtaaggatggccgctacagaacagacgatggctatgtctttaatccgacagatgttattgaagacacgggagatggttttatcgttccgcacggcgaccatttccactttattcctaaaaaagatttatcagctgccgaattgaaggctgctcaagattactggaatcaaaaaggaagtgtgagctcggctagtggtagtcaatatggcgatagaaataatagagctcaacagaccacaattagtgcggggcaaggtcaggatttggctagtttattggctcaattggatgcaacacccctatctcaacgccatgtagaagcggatggattggtatttgacccaagaacgattacgaagaaaaccgcagcaggtgtcatcgttccacacggcgatcattaccactttattccatacagccagatgtctcctctagaagagaagatttctcgaatgattggtgtaaatggagcaggtgtttcttctggcgcacaagcaagtcactcccaacatacactaacacaaccaaatcgtccagtaacaccaatcggcactgttacaacgcaaccggtatcgcctacacaaccagtattaccaacacaaccgaagcagtcaacagggaaagtggtttcctataagggacgtcaaattcctgcttacggaaaagggttagatggtaaggcatattttacaagtgatggatacacctttagcaaagactctattacctcagttgatgatcaagggttgatagctagtcatggagatcatttccattatgttggttttggcgaactcgaagattttgaaataaagcaagtagaggaatgggttaatgagaaggcgggcaaacaagtgccaccgaaaacatctgaacaagtaggaaacgatgctaaacccacaacaccaagtcaagggaatgattcaaaacctgtaaaaccaattcaagaagaaaaccgccctgcatttgaatataaacaagtaacggctaaacgtaaattggctggaaaagttgtttatgaaatggaagtaggtggaaaaacttatacgtatggtcgtgacgaactagatttgatgaagatctcttttgctgagttgactttggcagaaaaagataagcagtatatctttgatattgcaccgcttgcagaaggagatcttaagccagccatgttggtcggtatggatcaaattccgatgaagggagcgaatgcgacctatgatactggacaatcctttattattccacacattgatcacatccacgtcctaccttacacatggttgagtaaggaacaaattgcaacgatccgctatatcatgcaacatcctgaaattcgtccatctgcttggactacaagtggacatggtgatggagaagcaacggatcttgttcccccaattctaaatgcaacacctaaagcaaaccgcttaggcttgaaaaattggcaaatcattcacacagcagaagaagttatggatgcgcgtgcaaaagggaaatttgcgacaaatgatggctatatcttctcggcggaagacgtactagatccagcaagttttgtctttagtcaagcgttcagtctaccaagagcgacaggaggttctctacgttcaatttccaagaaagatttatctaaagaagaattggaagctgtacaaactcttcttgataaacgagacgctgaagaattggcgaaaaatgtcacaccaattgagaaacgtgcaggtttgaaaaattggcaaattgttcactcagcagaagaattggcagaagctaaggcagcaggaaaatatacaacaaaagatggctatatttttgacccagcggacctattagatcccaaagtgaaaataggtacggataactatcgcatcccacgtgtgattacagatggttaccgtcggattaacaagagtgatttgaattacttaagcgagctgatcccagcagaggctatggtggctcaacgtgagaaatctaattctagtttaccgtcaacacctgcaccaactgaaacaggagcaagtgcaggcgagacaacaacgccagaacagccacaagttgccaaagaaacagcagaggaaatttataaccgagtggaagcgaagaaagtcgttcctttcgaagcactgacttacaatgctggctatgcaaccgaagtacgcaacgggactctggtgattccgcatcaagatcactatcactatgtatcctttaaatggtttgaccaaggtagtgcaagaagtcctgaagggtatagtttagaagatttcctagcaacggttaaatactacatgactaatccacaagaacgcccagtttcagacgatggctggggagtatttacaccaaatacaccatctgaatcaacagaagaaacagagacggaagaaagtgatgaagaaattatttctgaagaaaccgaggaaattgacgagtttacagaagaattaaaacgaagagcagaagagtttggcatggacttcaaaacctttgaacaaagtctggtcacactctcagaccgttacaaagtttcttttgaagctttcgaatatgatgcagcaagcaaagttgttcgacttgtagataaggatggggtcaaacggaccatctcccttccaagtttagaagaacaagtatagtaaacaaaatacctgtagcactgagctctgcaggtatttttttacagaaaaacgataaagattatctttgactatttgccttttttagcgtaaaatagaagggaaagacaaaaaaggagaacagccttggaacttaacgtatttgcaggacaagaaaaaagcgaactttccatgattgaagtagcccgtgctattttggaagaacgtggacgtgacaacgaaatgtatttcaacgatttggtcaatgaaattcaaaactaccttgaaaaatcaaacagcgagattcgcgcagccctcccaaccttctattctgatttgaatgtggatggaagcttcattccgcttggcgaaaacaaatggggcttacgttcatggtacgcaatcgatgagatcgacgaagaagtgatcactcttgaagaagatgatgaagatgcaccaaaacgcaagaagaaacgcgtcaatgcctttatggacggtgatgatgatgcgattgactatggacatgatgatccggaagatgaggataactatccaggtagtgtatcatcagaatacgatgatgaaaatccagatgacgaaaaagatgaagttgagtcctatgattcagaaatcaacgaaattatcccagatgacgaattggatgaagaggatgttgatttaggtgaagatgacgacgagtattcagatgaagaggtcgtcgacgaataagaattatatccccatagattcttaaaaataatttgacaagactactgaattacgataagatattatcgggcacctcttttgaggtcggagctccctagcgatagggagctatttttgttttttcttcaagttaacaggaagtatccccacaaattgcttcctattagcctgaatcgtagaaaaggagtttgcatgacaaagtatatttttgtaacaggtggcgttgtttcctctatcggcaaagggattgtagcagccagcctaggtcgtttattgaagaatcgaggtctcaaggtaacaatccaaaaatttgatccatacatcaacattgacccgggaacaatgagtccgtatcaacacggtgaagtttttgtgacggatgacggtgcagaaaccgacttggaccttgggcattatgagcgtttcatcgacattaacctgaacaaatattcaaatgttacaacaggtaaaatttatagcgaagtcctccgtaaagagcgtaaaggggaatacttaggggcaacagttcaagttattccacacattacagatgctttgaaagacaaaatcaagcgtgcagctcgtactacagatgcagacgtcatcatcacagaagtgggtggtacagtaggtgatattgaaagcttgccattccttgaagcgcttcgtcagatgaaggcagatgtcggttcagacaatgttatgtatatccatacaacactcttgccttatctcaaagcagcaggcgaaatgaaaactaagccaacacaacattctgtaaaagagttgcgtggtctaggtattcagcccaacatgttggtaattcggacagagcagcctgctggacaaggaattaaaaataaactggcacaattctgtgatgttgctccagaagcagttattgagtccttggatgtcgaacatctttaccaaatcccattaaatatgcaagcacagaacatggatcaaattgtttgcgatcacttgaagctcgacgtacctccagcagatatgacagagtggacagcgatggtaaacaaggttcttaatctccagaaaaaagtaaaaatcgctttagttggtaagtatgtagaattacaagatgcctatatttctgtagttgaagctctaaaacactcaggatatgcaaatgatgctgctatcgaattggactgggtcaatgcaaatgatttgacagcagaaaacgtagctgaacgtctaggacaagcacaaggaattatcgttcctggtggctttggacaacgtggtacagaagggaaaatacaagccattcgttatgctcgtgagaatgacgtgccaatgctaggggtctgcttgggaatgcagctgacctgtgtagaatttgcacgtcacgttctcggtttagaaggtgctaacagctttgaattagacccagaaacaaaatatccaattattgacatcatgcgtgatcaaattggagtggaagatttaggaggaactctccgtttaggtctttatccaagcaagctcaaacgtggctccaaggctgcagctgcttatgataatcaagaagttgtacaacgtcgccatcgtcatcgttatgagtttaataatgacttccgtgaacaatttgaaaaagcaggttttgttttctcaggcgtgtcaccagacaaccgtttggtagaaattgttgaaattccagaaaataaattcttcgttgcctgccaataccatccagaactacaatctcgtcctaatcgccctgaaggtttgtatacagcctttgtttcagcagctatggagaatgaaaaataagtataaccattatagaagaagattggtatcattcaatcttctttatatattttatataaagaaacgaaaaaggtgtcagtattttatagaagaaaatacgaaataccacccccatatggcatcattgtctagatggttttaagcattatatatagtagaatattgcaaaagaatcagctaaatcaatacgttttggcaaaaaaaggtaaaaataaaaaataaaattcaaaaaaagtgttgacaaggctagttcctaatgatatactagttcttgtgttaagcggggatggcggaattggcagacgcgcaggactaaggatcctgtgaccgctttaggtcgtgtgggttcaagtcccactctccgcatagtggactagctaaggctagtccttttgctttgtctagataagtgcagagcacgatatatgctagttcataaattacaagaatgatacgaaacaggcattattatggctttcatgaaaagatatgtgaaagttttctcaaaactagacggtttcaactagcattttcaaaataaaaatggtagaatagaagagtatgaggtgcaacctcaaaaaatattaggaggctatcgaaatgccattagtttcagcagaaaaatttgtccaagcagctcgtgacaacggttatgcagttggtggatttaacacaaacaaccttgagtggactcaagctatcttgcgtgcagcagaagcaaaacaagctccagttcttatccaaacttctatgggtgcagctaagtacatgggtggttacaaagtagctcgtaacttgattgcaaacttgattgaatcaatgaacattacagttccagttgctattcaccttgaccacggtcactacgaagatgcacttgagtgtatcgaagttggttacacttctatcatgtttgacggttcacaccttccagtagaagaaaaccttgcaaaagcaaaagaagttgtagaattggcgcacgctaaaggtatctcagttgaagctgaagttggtactatcggtggtgaagaagatggtatcgtaggtagcggtgaattggctccaatcgaagatgcagtagcaatggttgcaactggtatcgatttcttggcagcaggtatcggtaacatccacggtccatacccagcaaactgggaaggtcttgaccttgaccacttgcgtaaattgactgaagctgtaccaggtttcccaatcgtattgcacggtggttcaggtattccggatgcacaaatccaagaagcaatcaaattgggtgttgctaaagttaacgtaaacactgagtgccaaatcgcatttgcaaacgcaactcgtaagtttgcagcagcttatgaagcaaacgaagcagaatacgataagaaaaaactctttgacccacgtaaattcttggcagacggcgtgaaagctatccaagcatctgttgaagagcgtatcgacgtattcggttcagcgaacaaagcttaatgtaactgcgaagaaatcttagatttcaagcaaacaaagcataagtttcttagattaaaccaaaaaggattttctttcgagaatcctttttattataatagttgattaagtttgatctagttctttgctatgaagaaatctacgatagaagtgagcagagaacagttaaaatataaactgctccaaagttttcatgactgtaataacttagagaacgaagaattatggatggggcgcaaactgtagtattaaaatatttacctatgagtatagacactttaaaaaataaaaatgaaaataattcttgccaagtccaatcttttctgttagaataatatggtatgtggtgctagcacatccgatatatttgatcaaatgaggaggaagatacaatggctaaagtatgttatttcactggtcgtaagactgtatcaggtaacaaccgttcacacgctatgaaccaaactaaacgtgcagttaaaccaaaccttcaaaaggtaactgttttgattgatggtaaacctaaaaaagtttgggcttcagcgcgtgcactaaaatcaggcaaagttgaacgtgtataataacaaagtcgttagaaaaatctagcgacttttgtttttggaaaaaatagcctagatataaagtcggtgaggagcaaattcgaccactacataatgaataggaaagaatatcagctatatagctcttcacattgctgttgaaaagttaacaaagaaggaatgttgtcaaaaataaactgtgtattgatgtggaagatttttccaagttcgaacatttaaacttggattgacattaggagttgtacgagagagcatccgtacgggttctacaagaagggaatcacgaactggaagaatagagagtgtttaaaaaaatccaaaaaatctcaaaaaaccggttgacaatgtatataagtcatgatagaataaatgagttgtctcttgagggactagttaacagagaaacgaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcatattccgccatagctcagttggtagagcgcatgactgttaatcatgatgtcacaggttcgagccctgttggcggagtaaagagaaatctttagtatatggtccgttggtcaaggggttaagacaccgccttttcacggcggtaacacgggttcgaatcccgtacggactatatttggagactgcttaagtctcttttttttgttttttgaggtgtatgggctttaatatggctcctttttcttttcttgttactttgtctattcattgtttgttgatataatagagatatgaaaagactatgtgatgaattatcggttttgccagggattggtccaaaatcggctgaaaaattcttaaaaattagcattcagaatattaatgatttgctgacttactatccatttagatatgaagattttgagagtaagtctatttatgatttgcaggatggggagaaggcagtggtagttggggaggtggtatctccagctaatgtacagtattatggttacaaaagaaatagactccgtttttcaatgaaacagggtgaggttgtcttagcagtttcgttttttaatcagccttatttagcagataagattgttttggggcaggatattgcagtttggggaaagtgggataaggctaaggcaagtttgacaggaatgaaaattttggctcaagtatcagatgagctccaacctgtctatcatgtggcgcaagggatttcgcaagtaaatttggttaaggctattaaaacagctattgatcagggatatttgcatttattagaggagaacttgccatcagttttacgagagcgctatcggttaatgaatcgccgagaggcggtttttgcgatgcattttcctacaaatttagaagagtatagacaagctttgcgacgtatgaagtttgaggaattattttattttcaattacagttgcaaatgctgaaagccaacaatcgtgatattttgaatggtttgaagattgcctatgatgctgatagattggctatgcaaataagacaattgccgtttgtcttaacagatgctcagtctggggctttggctgaaatactatcagatatgaagtcctatgggcacatgaatcgtttgttacaaggggatgttggttcagggaagacagtagttgctggattggctatgtttgctgctgtgactgcggggatgcaggctgcaattatggtgccgacagaaattttggctgagcaacactttgagagtttgcgccagctttttccagaactttctattgctcttttgacaggtggaatgaaagctgcggagcgtcgtactgctttagaggcgatttctagtggtcaggtagacatcattgtaggaactcatgctcttatacaggaaagtgtgacgtaccataagcttggtttggttgtgacggatgagcaacatcgttttggtgttaaacagcgccgtctgtttcgtgagaagggtgataatccggatgtgcttatgatgactgctacacctattcctcggacgttagccattacagcttttggagatatggatgtatcaattattaatcagttacctgctggtcgaaagccaattatcactcgctgggtcaaacatcaacagctgcccacggtcttagattggttggagcgggagttagaagtgggtgctcaggtttattttatctctccgctgattgaagaatctgaggctctagatttaaagaatgctgtagatctacaatctgatttacaggcgcattttggagagcaagttacagtggatttgttacacggtaagatgaagaatgacgagaaagatgccatcatgcaggcttttaaggagcgaaaaacgaatattttggtttctaccactgttattgaagtcggagtcaatgtgcccaatgcaacggtgatggttattatggatgctgatcgttttggtttaagccaattacatcagttgagagggcgtgtaggacgtggtcataagcagtcttatgcagtgttagttgctaatcctaaaacagagtctggtaaggaacgcatgaaaattatgacagagacgacagatggttttattttggctgaagctgacttaaaaatgcgtgggtctggagaaatatttggaactcgtcaatcaggtttgccagaatttcaagttgcaaatattatcgaggactatccaattttagaggaagcaaggcgagttgctagtcagattgttagcgtggaaaattggcaggaggaccctaattggtcgattttgcttgctaatttgaaagatcgagaggaattggactagtcatataaaaaaggccaacacacatgtgttggtcttttgacatattgtatagttcgtcagcgattaaccttggatgtaatctgccaagctttgctcttccaagcctgcattgagagcgataaggagtttgagtcgggctttttgagcattcaattctttaacaaatagaatgccgtctttctccagttggatgccacctccttggtaggcatagacaggctcagcaattccgttaaaacagcgagataccagaataatgggtatcttttgatcaaggagtttcttaatggctggaaggatggtaggcggaagatttccggcgccgagtgcttcaataactaaaccggaaattgagcttgcagtgagtgaatcaaggagaatggagtccatatctgcataagcttttatgattgggaccgttcctgtgactgttgataagtcaaatcgaacacgtggttcagcagttttaaaatagagaatctctcgtttggtgactaatcccagtggtccatgggttggtgtttgaaaggttgagacattggtggtatacgtttttgtaacatatttagcagcatgaatttcatcgttcatgaccactagaacacctttatctgcggatttatcatcagtagccacacgtagggctgttcggtagttataaatcccgtcgctacccagttcatttgaggaacgcatggctccggtcaatacaattggtttttctggaatagccattgtatcaaggaaataggcagtctcttctaaagtatctgtgccatgtgtaatgacaaaaccatcgaagttcatttgttcttctttgattttttggtatagagtcatcatgtgttctaagcgaatgtgtggacttggaacattgagaaaatccaaggatgtcacttgagtttcttctagtgggctatcaatttgggtcattggattggttttattcgctgcaacttcaccctgatgattggtttgcatagaaatggttccacctgtatgcagtactagaatttttttcataaattttcagtttctttcaaagtgtgatatactaattgtaacataattcttagaaagtaggtgagttggttgacgataaaggctgtatttttcgatattgatggtaccttattgaccgacaatcgtatggttagtagttcaactattctcgccattaatgctttgaaagagaaggggattttagttggtctagctacaggacgtgatcctcgttttgttttgcagtatatggctagtttagggctagatttggccattgcttataatggtcaatatattttttcaagagaagaagttatttatagtcagagtttagagccaaagcaaattgaacaaattatggagtatgcgcaaactcaccataaggatttatcttttggaactgctaaaggcatatttggtagtaagattatgagtgctggaacaggaaattttgcatatcgtgtgacgcgtatgattccggagtcctgggctggaatcataaattttattttcaatcgtttggtacgttggattagtcctcaacaggaaacgaatttgaaaggttttctctttcaaccaatctatcagctgatgttgctgacgacggaaagggagacacaatcattggaggtgctctttccgaacttgtcttttacgcgttcgagtccctatgcgactgatattatcagtaagggaaattcaaaattatcgggtattgtaaaggttgcagatcgatatggttttgagttagatgaagttatggtattcggggattctaataatgattttgaaatgttgaatgaaattcagcactcggtagcgatgggaaatgggacgaaaaaggttaaacacgcagcttcctttgttacggatacaaataatcgtgatgggatttataaggcattaattcattttggtgtgattgagggataagatgtttcagagcaaggacgataattttaatagggtaaaggattttcattttttaatggatggtgaaacacaagaacttcccagtgtgtatgatggacagacggctttgtatcgcgctggttttaaattggaggagttggtagaatttctacatgcagcttcagaatctgaagttgagtttcatgattttattcaacaacttcatcaggatttagatactgctgctgctaaggtatctggcaagagaggtttcggggtttcgatgcaggatcaggtagatgctttgctggatattctttattttacatatggttcgtttgttttgatgggggttgatccagaaccaatttttcagatagtccatactgcaaatatggggaaaacatttccagatgggaaggcccattttgatccaattacccataaaattttaaaacctgatgattgggaagaacggtttgctccggaggaaaagattcaggaagagctgaaaagacagatgaaaagacttgattcgtaaatcaagtcttttggtttataaacttttttctccatcgcgaacaatgagtaaatcgatagttgcgtggcgcatgatatattcggatgaggatccgattaggagacgttcaaaggcgtttagaccagttgctccaagtaacataagatccgcaccggtttcctttggaatatcgatagccagtagggttttagggttaccgaattcaatgcgaatctgtacatcggtcagaccggcgttgagagcttcttgtttgtattcttcgaggaggagctccgcctctctttctaaagattcatagacagaggcgtcaaatgcaacaacattgtggagagcacgggtgtcaatcacatgggcgataatcagacgtgcttggttgcgtagtgcaacatgaatggctttatgaagagctaattctgctcctttagagccgtctacagcgacgagtattgttttgtaagattgtgtcataatagtcactcctttcagaagagctttgtcccgaaataggtagagtagttccttacatttttattataagccttttgagagaaaatgtaaaggattcttgtacttttttagcttttacagtacaatagaaaagatagaaagttgaggtgacgacatgaagcaatttaacaagtcaacaaaattggatgatgtagcatatgatattcgtgggcctgttttggaagaggccatgcgcatgcgtgccaatggagagcagattttacgtttgaatacggggaatcctgcagaatttggttttactgctccagatgaagttattcgtgacttgattcataacgcccgtaaatcagagggatattcgaacagtaagggaattttttctgcacgtaaggctatcatgcagtattgtcagctaaagaaatttccaaatgttgacattgaagatatttatcttggaaacggcgtgagtgagctgattgttatgtctatgcaaggtttgctagataatggtgatgaggtgttggtgccaatgccagactatcctctctggactgctgcagttagtttggctggtggtaaagctgttcactatgtttgtgatgaagtagctgaatggtatccagatttggcagatatggagtccaaggtgacttctcgaaccaaggcaattgtccttatcaatccaaataatccaactggtgctctctatccgaaagaaattttaaaaggaatcattgatattgctcgtagacatgaattgatcattttctctgatgagatttatgatcgtatggtctttgatggagctgttcatatccctattgcgacactggctccagatttatttgttgtgacgatgaatggactgtctaaatcacatcgtatttgtggtttccgagtaggttggatggtcttatctggtccgaaaaagcatgtaaaaggttacattgaaggcttgaatatgttgtccaatatgcgtttgtgttcaaacgttttggctcaacaggttgttcaaacttctttgggaggttaccaatcggttgatgagctcttgatgcctggcggacgcttatatgaacaaagggagttcattaccaaggcgattaatgatattccgggactttctgctgtaaaacctaaggctggtctgtatgtattcccaaaaattgatcgtgagatgtacagagttgaggatgatgaacaatttgtattggatttcctcaagcaagaaaaagtacttttggtccatggtcgaggttttaactggaaggatccagatcatttccgtattgtgtatttaccacgtgttgatgagttggcagaaattcaagaaaaaatgtcacgattcttgcggcaatatcgtagataatgggagtgggaaagaactcaaccattcataagaagagttcgtcaacaagtctttatttctagttgttgagctgaaacagtctattcccagactgtttcgctcccacctccgcacagctcaaactgtctgggagacagtttgaggttggagatgaagcgaactctgttcgcatcagtcgtataggtcagattttgaatgtaaaacacgaacgaatctgccaatcaaccactgcgctgagatgttgacactaactttgagaagcggtgctgggctttttgcccagcctatttctttttgcttggatgaaattgtttgtgtttttctaacaacggtaaatattctgataattgttgaaattttatgtattttttgctatactgaaagcaattacagagtaaagaggaaaatatgacaacattattagagaagacacggaatattacttctattttgaagcgttccgaagagcaattggcagaagaattgccttacaatgctattgctgaacatctatcagctattattgattgcaattcttgtattattaatagcgaaggtgaagttttgggataccacatgagttacgagacaaacaatgatcgtgtggaagaatttttccaaaacaaacaattcccagaaggatatgtaaaagcagttgcgcaggtttacgatacgcaggttaatttgcctgtcgagagcgagttgactgccatccctgtcgaatcacgctcgacttatccaaacgggctgacaacgatagcgcctatccacgtaacggggattcgttttggttcgcttattatttggcggaatgatgagcagtttcacgatgatgatttgattttggttgagattgcggcaacagtagttggtattcagttacttaatttccaacgggaagaagacgagaagaatatccgtcgtcgtgcggcagttaatatggcggtaaatacgctatcttactcagaaatgaaggcagttgcagctattttgggtgaattggatggcaatgaggggcaattgactgcttctgtgattgcagatcgtatcggtattacacgatcggtgattgtgaatgcactgcgtaagttggagagtgcagggattattgaaagtcgttctttgggaatgaaggggacttatttgaaagttctcatcccagctatttttgatgaaattaagaaacgtgactactaaaatgacaaaagcattgattatatagtagattttgtggcagatgaaggaaagctgactgctggaaaatcagctcaggctatttctaaacgaattgctcaggttacgcaagaagcttttgaaaatggagactatattttctttgcgattgatggtcatgaggagggggatgaatttcatcctgaagctcagcttttcccaagtcataatatcattgggacgcaagggcgtgacttgtatggtcctttagcagatttttatcaaaaacataaagggcatgcgcgtgttcgttggatggataaacgtcattattctactttttctgggacggatttggatgttcgactaagagaacgtggtgtagatacggttgtcttgacgggtgttttgtctgatatttgtgttcttcatacagctattgatgcttataataaggggtatcgtattgaggtggtctcatcagccattgctgcattgacggaggagaatcatcagtttgctcttaaccatttgcgtcatgtactcggtgcgacaattattgattaatagtatagtgaccagtctgtggactggtttttacaggaatctgtatcattaacactcttcgaaaatcaaactcagaccttgttgacttaacttgtaaaagaagcggtgtgattgaccatgataaatttatcaaaatgctttacataggtgattacttggtgtataatatagtctgtgtgtaatggacgcacaaaaatacagtttatccgctgggtttaaaagcacctaagattgacaaagataggagaataaaatgaatccattgatccaaagtttgacagaaggtcaacttcgtactgacatcccttcattccgtcctggtgacactgtgcgtgttcacgctaaggttgtcgaaggtaaccgcgaacgtatccagattttcgagggtgttgttatctctcgtaaaggtcaaggcatctcagaaatgtacactgtacgtaaaatctctggtggtgtaggtgttgaacgtacattcccaatccacactccacgtgttgataagattgaagtagtacgttacggtaaagtacgtcgtgctaaattgtactacctacgtgcattgcaaggtaaagcagcacgtatcaaagaaatccgtcgttaagatagtcctacagactattttggtcggagaatgggaggcagcgaaagctgtctctttttttaaaaaaaatctgttgaaaaagtaccaaattgtgaaagcataaaatggaaataatatgttatactatatattattgtagcgagtatagaggaggttgcggatgagcgaacagtttattccatctgttttatcagatttacggcaagatattgttcagatgccagaagttatcaaggaatgtagtggaattcgtatttatggtcgtcgcattcgttcagtcttatttacaacggatgtgtctattattgctaatcacaatgcagatgctattttggctgtttatccatttacgcccagtccagctattatcaaaagtattatgttggttgcgtcagttccagtcttggctggtgttggtggaggcttgacgacaggtatgcgttcagctaatatgagtctcttgtctgagtcggagggagcatacgctgttgtggtaaatggaccaacggatgtaaaaacaattgaggcaatcaataaagtagtagatattcctatcatttataccgttgtttctgaaaagtctgatttaacctcacggattaaagctggagtagatattttaaatgtttcttgcggtatggaaacgccaagggttgtgaagaagattcgagaagctttccctgactttccaattattgcgactggtggtccgactgaggactctattcgtcgggttatcgaagctggagccaatgctgtctcctatacagcaccaagtaatggggagctttttaaagggaaaatggaaaaataccgcaaacatgcaaaggattagctcataaaaagataggctaagcaaacagtaagttttattgctagatgaaacttgctgttttttatcgttttacggtgtgagattaggaatacttcgcaatttaaagaatggatttttaggaggaaataggtaacatattaggtcatttctacctttgtctgaggctggaaatatggtataatgagaagatagatttccattaggaggaaagtaagaatgaagatttctgaagctgaagtccgtcacgttgccaagctgtctaagctggaattttcggaccaggaaacagcggaatttgcgacaagtttgagcaagattgtcgatatggttgaattgctcaatgaagtagatacgacaggtgttgcggtaacgaccactatggctgaccgtaagaatgtcttgcgagcagatattgcccaaaaaggtgagagccgtgaggagctctttaaaaatgtgcctgaatcacaagataactttatcaaggtaccagctattctagacgggggaggagatgcctaatgacttttaacaataaaaccattgatgaattgcatgacctccttgtcaaaaaggagatttctgcggttgagttgaccaaggcaactttggaagacatcaaaagccgtgagggagcagtggatgctttcttgactatcacagaagatgcggccttggcgcaggctgctgcccttgatgaaaaagggattgatgcggacaatgttatggcagggattcctttggcagtcaaggacaatatctctactaaggggattttgaccacggcagcttcaaaaatgctttataactacgagccgattttcgatgcgacatcagttgctcaggcctacgcaaaggatatgattattgtcggtaagacaaacatggatgagtttgccatgggtggttctaatgagaactctgccttcaaaccgactaaaaatgcttgggaccagacaaaagttcctggtggttcttcaggtggctcagctgctgctgttgcatctggtcaggtccgtttgtcactcggttctgacacaggtggttccattcgtcaaccagcagcctttaatggtatcgtcggtatgaaaccgacctacggaacggtgtcacgttttggtctgattgcctttggttcatctcttgaccagattggtccattctcacagacagttaaggaaaatgcccagttgctcaatgtcatctctggtcatgatgtcaaggatgcaacatcaacgatcaatgaaattgcagacttcactagcaagattggtcaggacatcaagggcatgaaaatcgctcttccaaaagaatacatgggcgaagggattgatccgcaggtcaaggaaactattctcaaggcggctaagcacttggaaagcttgggagcaatcattgaagaagttagtctgccacattctaagtatggggttgctgtttactatattatcgcatcatcagaggcgtcttctaacttgcagcgttttgacggtatccgctatggtttccgtgcagaagatgcgaccaacttggatgagatttatgtgaaaacccgtagccaaggttttggtgaggaagtcaaacgtcgtattatgttaggtacatttagcttgtcatctggttactacgatgcctacttcaagaaggctggtcaggtgcggaccttgattatccaagattttgaaaaggtctttgcggactatgacttgattttggggccaactgctccgacggttgcctttggtttggacacgctcaaccatgaccctgtggccatgtacttggcggacttgttaacaattcctgtaaacttggcaggtcttcctggtctttctattcctgctggttttgtagaaggcttgccagttggtttgcagttgattggtccaaaatactcagaagagaccatttaccaagtagctgctgcctttgaagcgacgacagactaccacaagcaacaaccagtgatttttggaggtgctaactaatgaactttgaaacgattattggtctagaagtccatgtggagttgaataccaactcgaaaattttctcaccttcatctgcgcattttggtgaggatccaaatgccaataccaacgtgattgactggtctttccctggcgtccttcctgttcttaataagggtgttgtggatgctggtattaaggctgccttggctttgaacatggacattcacaaggacatgcactttgaccgcaagaactatttctatcctgataaccctaaagcctatcagatttctcagtttgacgagccgattggctacaatggctggattgagattgagctagaagatggttcaaccaagaaaatccgtatcgagcgtgcgcacttggaagaggatgcaggtaagaatacccatgggacagacggctattcttatgtggacctcaaccgtcagggcgtgccattgattgagattgtatcagaagcggatatgcgttcgcctgaggaggcctatgcctacttgacagcccttaaagaaatcattcagtacactggtatttcagatgtgaagatggaagagggttctatgcgcgtggatgccaacatctctcttcgtccttatggtcaggagaaattcggtaccaagactgagttgaaaaacctcaactccttcaactatgtgcgcaagggcttgcagcatgaagtagaacgtcaggcgaaaatcttgcgttcaggtggtcaaatccagcaggaaactcgtcgttacgatgaatctactggtgaaaccattctcatgcgtgtcaaggagggttcagctgactaccgttacttccctgagccagacctgccactctatgagattgatgatagctggattgaggaagttcgtgcagaattgccagtctttccaaaggctcgccgtgctcactatgtagaaaacttgggcttgaccgcctatgatgcaggtcaattgacgtctaccaaggccttgtctgacttctttgaagcagcggtggcagcaggtggcgatgccaaacaagtttctaactggttgcagggtgaagtggctcagttcctcaatgctgaaggtaagactattgagcaaatcgccttaacaccagaaaacttggttgagatgattgccttgattgcggatggaaccatttcatctaaaatcgccaagaaagtctttgttcacttggccaaagaaggtggctctgctaaggcttatgttgagaaggctggtttggtgcagatttcagacccagcagtcctcattccgattatccaccaagtctttgcggataacgaagcggctgtagctgacttcaagtctggcaaacgcaatgcagacaaggcttttacaggtttcttgatgaaagcaaccaagggacaagccaatccacaagttgcacaacaactcttggctcaggaattggctaagttgttggattagttttaaaactatagaaactatagaatacaaaaatcactcaaaaagagtggttttttgttgactaaaataataattattattatcatcatgatataaaggtatgagggggaataaatagatatgtcaaaagacttcgatgattttttacgagaacatgaggagaatgtcaataagttaaagaaacgtgataaggaaactgagtcggataaggaaagagcaagagatgaattttctagagattattccagggtaatctattctaattcctttagacggcaacaagggaaaatgcaactgtttgccgttaatggtagagcttttcacaggaacaggctgacacatagttttgaagtggcacagattgcaagggggattgttgattatttgaaaaaaaatacatctaataatattgatatagatttcaattcgatgtctgtcgttgttgaaactggtgcacttgtacacgacattggcaatcccccatttggtcatcatggagaaagaattttaaatgatttggcaaaggatattggttttgaaggaaatgcccaagggttacgggtattaaaaaatattgaaaaaaagtctccagatcataaaggcttaaacttaacatatagaaccctagcttcaattctaaaatattatgttccatatagaaaatcacgaaagactgagaagttcatatacaaagaagattatgaggaatttaaaaagagatttaaagaaatggatgtgtttgtgagaacaattgatgttcaaattgttgatttggcagatgaaattgcttattgtgcacatgacttggaagatgcattggcgagtaactacttcaccattgatcaatttgtatttttgttggaacagaaattgggagaagatcaaacattagaggattttaaggaatggattgaagaggcaaaaaataaggcaaaaagaagtaaatccaatgatgattatgatttttattttagacgagaattgctttctattattgtgaataaattcattgaggatatagacattgtagaacttaatgaaaaagacaagaaaaaattaggaactgatcaggatcaagaactagggctcggtcattataaaaaacttgctggtgcattgaagaaaacaattttcgaaggcgtaacaaattctgacgatattattttatatgaaaatgttgggacgaaagtgttgactagattatttgctttattcatgaatgaagaatataatcgggagagttttttgatgccgatcgaatatcgatttgaaaaagacgatacccaaagtgacaagaaaagaaaagtactagattatatttctggcatgatggacacttacgcaattgagatgtatataaaacattttggtacagatccgttcttagagaaatatgatgcagctatattcaagaaaggaactggtaaaaagctaatagaatgtttagcacaaaatttcttacataaatagccatatgtttaagaaaaccgagagttcgtgttgaattctcgggttttcttatgcacttttagtaagaactctcgcgtattaccagctgggtacccaacttaatcttacgggggtggtggggcgttggacttgttatgatacggtccagtagctgcatagcttcctggcccatttcctcagtgaagacgctgatggaagacagggctggatagacttggcgcgtgatggctgtatcgttaaaggtgatgagttggattctatctggcactgcgatttgacgttcttgtaaagcacgcagggcaccgacagccagagtatcgtttgccatgaaaaaggcagggggtagcttgtcgcctaggtcctcaatagcctggctcatcagctcatatcccgactgggtggagaattttccttgatagatgtagtcttcttggagcatgcccaaggtgtctaggtagtcacgaaaggcagtcaggcgggggtctgttggcagttggtgtccatctgtggtttcttcctgtccgactaggagtccaatatcagtcagaccttgtgaatggaagtggtcgataactgtctgaacagagtgttcaaagtcagttgtgacgcaggagaatccctcggtcagcgtatcagagtccacaaaaatgattttagaagacaggctagatagctctgctatttgtccagaagaaaatttgccaactgcgatgatgccgtccacttcttggaggaggggattggtcaggtcgttgaaggagcggacgatttggtagccgagtaagctggcggtatgctcaatactggcccgaatggagtagtagtagaggtcggccagctcttcgctctcggtgtaccactgaacaataccgatggtgcctttttgttgaggtgcttgttttttgatgtgcttggtgtagcccaattcctgtgccaagttgaaaatgcggtcgcgggtttcttggctgacggatagggtcaggtctcccttgagaacgcgggaaacggtggcagaggaaaggtgggcttgttttgctatgtctttgattgtaaccatgttcttctcctgtttatttgtctctagtatagcataaaaaaacaaaattagtaaaaatttagtaaaaatattgacttttaaattgttgagttgtacaataaaagaaaacgattacaaaatctaggaggttcttatgaacacagaacaactcaagcaggcctttctcgatgtgtttggtcaagaggcagatgcgactttcttctcaccaggtcggattaatttgattggtgagcacacggactacaatggtggtcatgtctttccagcggctattaccttggggacctacggggctgctcgcaaacgtgatgaccaagttttgcgtttctattccgcaaactttgaagaacttggaattatcgaagtggatttgaacaatctggtctttgataaggcggataactggaccaactatgccaagggggttctcaaattcttgaaagaagcagggcatgtcattgatacagggatggaagtctttgtttacggtaacattccaaacggttcaggcttgtcatcatcagcttccttggaactcttgattggcattatcgcagaagagttgtatggacttgaattgactcgacttgatttggtgaaaattgggaaacaaacggaaaatcactttattggtgtcaattctgggatcatggaccagtttgcgatcggtatgggagcagataatcgggcgatttatctagataccaatagcttggagtatgaattggtaccgctagatttgggtgaccatgtgattgtgatcatgaacaccaacaaacgccgtgaattggcagattctaagtacaatgaacgtcgcgcagaatgtgaaaaagcagtggaagaattgaatgctgtcctgaacattcaaactctgggagaattggatgaatggacctttgatcaatatagttatttgattaaggatgaaaatcgtatcaagcgtgcccgccatgctgttttggaaaatcaacggaccttgcaggctcgtaaggccttggaagaaggagatttggctacctttggtcgtctggtcaatgcttcccatgtttccttggaacatgattatgaagtgacaggtttggaattggataccttggctcacacagcttgggagcaagaaggagttcttggtgctcggatgacaggagctggcttcggtggctgtggtattgccattgtccacaaggataaggtggaagccttcaaagaaaatgtcggcaagacctatacagaggttgtgggctatgcaccaagcttctatgtagcggagattgctggaggctctcgcgttttatctcgaaaatagattggagaaatgatgacaggattggtggatcgttttgttgagcaggttattgccaacagtgattttgaggaaatggatgctatctacctgcgaaatcgggtcttggctttggtgggagaccaggttctgactgttcaaacagatttagaggacttgattgaattaaaagatgaactattggcacatggagttcgaactggttttgtgggtgaattgctggaagagcaggacatggttgggtcttgtttgatggatttgatgacaccgagtccgagtcaggtcaatcgtgatttttggcagacctatcaggatagtccagagcaagcgattagtgacttttatgaattgagcaaacgtaatgactatatcaagatggctgcgattgcgaaaaatatctattatccagtttcgacagagtatggggatttggaaatcacgatcaatctgtccaaacctgagaaggatcccaagtctattgcagctgctacgaaagctgaagcaagcaattatcccaaatgcctactctgcatggaaaatgagggctatcagggacggattaatcatcctgcacgcgccaaccaccgcattattcgcttggagcttggacaggaaaagtggggcttccagtattcgccctatgcttactacaatgaacatgctattttcctaaatcaggaacatgtgccgatggttattagtccgcgaacttttgagcagctcttggacttgttggatttgttgccaggttattttgtcggttccaactctgacctccctatctcgggtggctctatcttgacccacaatcactatcagggtgggcggcacagttttgccatggatcaggcgccgatagaacaccagctggtcttcgaaggctttgagtcagtttcggctggcattgtcaaatggcccatgtcggtgattcgcttgagttcagcagacaaaccgtcgcttcttggtttagcggctaagattttggaaaaatggcggagctactcagatgatagcgttcagattaaggctgagacagatggaacaccccatcatacgattaccccaattgctcggaaacgaggcgatttgtacgagctggatttggttctccgcgataatcaaacttcagaagagtttccagatggcatctatcatccacatccagatgtgcaacatatcaagaaagaaaatatcggcttgattgaggtaatgggcttggcgattttacccccacgcttgaaggcagaattggctgaagtagaaaaattcttactgggtcaagatagtcaggtggctgactatcatcagccttgggcggaaagcctgaaaacagctcacccagatgtgacggaagaaactgtcgaacaagtagttcgtgagtcagtgggacaaatctttgcgcgtgtattggaagatgcaggggtctacaaacgtactccagaaggacaggcagcctttctacgattcgtagaatttgtaggtttagcaacataaatgtaagaaagagtgggacggtgtcctgctctttttggtataatggaagtattcacagtgtgagaaggagatatgatggcggaaaagagattggggacactgattacagtaatagcaggtatagcctggggcttgtctggagtgagtggacagtacttgatgtctcgtggtgtttcagtggatatgattacctccctgcgtttgttggtgtcgggactctttctcgttggcctggcttatgctacagcgaaagaacagctattggcagttttgaaagataaaaatgccttgctaggaatttttatctttgccatgcttggcttagttcttaatcagacagcctatttacaagccatctatcataccaatgcgggaacggctactgttctacaatatctctgtcctattttggttttggcatatacctgtttgaaaaatagggaaaaaccatcagggattgagttgatttcaattatcttagctatagcaggcacttttttgattgcgactcatggcaaattagatgaattggcagtgactccaatcggtttgttctggggaatcttctcagcctttacttatgcgctatatattattttgccaggtaaattgattcgtcaatacggcagtataacggtgattggtttagggatgttaatgggtggttttgtagtcacgcttggtttgcaaacttggcagcatcgtcttcctattgatggtggaagtttcctgggcctgttaggtattgtcggagtcgggacgatttttgcctatactgcctttcttaaaggcgtcagtatggttggtcctgtcaatggcagtcttttggcctcgattgagccgattgcatctgtcttttttgcagtatggttggtcaatgaacaattttatgcaattgattttgttggaatgttgttgattttacttgctgttttgcttatttctttaaaagatatattggttgcccaaaagagtattggttaatatactcttttttgttatactaaagaaaaaacttgaaaggaataaagatgattaaagaattttgttccgaaaatcatgtaggtgtgatgaaggccctatccctaggagctaaacggattgagctctgtgataatttggcagtcggagggacgacgccgagttatggagtggtcaaacatgtttgtcaactggcccatgagaatgaagccacagtcatgaccatgattcgccctcgcggtggagatttttgctacgataaagcagaggttgaaatgatggttgaagattgtaaagcagcgattgaactgggggcagatggtctggtttatggtttgttaaccgaggaaaattggttggacgaaccagccttggaaagactgtttgctgtttcgcaggactgtcagattgtctttcacatggcttttgaccaaattcctcgcgaacgccaattcgaggctcttgattggctggtagaacatggagtgacacggattttgatgcgtgggagtctgacagggtctgccttgaacaatgtggaatggttacaggaaattgtcgcctatgcacaaggtaaaattgagattttgattggtggaggattgactgtggacaatgtgccaacgttattagaagcattaccaatcaatcaagtacatggaacgagattattttggtaaggtagctttgaaagtgaaataaattacagagtaataatcgaagtttattcagaaatgtttagaagttaaggtttgtttaagcattggaagatacaatatatttattctttttcatataatctccacggaagcagtcgacatgttcggctgttttcatttttgtttgttaaagtccggtatacagactagaaactgctgcgtctctattgaatcccctacgtaaagaattgagaactgtggctgttgaggtgagtgatttagctttggactatgctgttcgtttagcccaatccttgaatagtactttgcgttatcataattatgatagcttgattgccattgctaaaaccaaaggagtagaaccgaaaggtaaggattgtcaatcattttcagagtacagacagcgttacagtctctatgatgctaagaagttaatttatcgcgctctcgcgtggcgtctattcgatgatagtcatgcagattatggacatgctcttaccattttggggttggatgaggatgagtcaggagtagagcaaatcggttttgctttttcaaaatttactcttgatattgattgattgctaacccatatgattttcattccgaaagattggattttggaagaaggtcagatttaattcacaactaccattacattacctccagaaggcactcggttgatccgagtgttttctgctatcgattcgcatttttcttagaaaaatggtataattatctgataaaaaactttggagacgacagtgagtttagaaaattacatgccggattttgccttggaaaaggcttatgacgtgaccgtcgaaagcttgaaaaaacatggcataaaagtagtgtttgttgacttggataataccttgattgcttggaataatcccgatggtacgccagagatgcgccagtggttacatgatttgcaggacgcaggtattcctgttgtggtggtgtctaacaataaatacgaacgtgtcaaacgggcggttgaaaaatttgggattgaatttgaagccttcgctctcaagcctttcacctttgggattaaccgtgctttgaaacgctttgatgtccagccgtatgaggtaattatgattggcgatcagctgatgacggatattcgggctgctaagcgagctggtctcaagtctgtcttggtcaaacccttgataaagacggactctatcaatacgcagattaaccgttggcgtgagcgacggactatgaaaaaaatcatcgctaaatatggagcgatagactacaagagggagatgtaagtggaagaattattttgtatcggctgtggtgcccagattcagacgctagacaaggctgtcgctggttttacacctcaatcagccctagaaaaaggcctggaaacagggcaactctactgccaacgttgtttccgtttgcgccattacaatgagatttcagatgtcaatatctcagacgatgatttcttgaaactcctccatagcgtaggagaaagcgatgccttggtggttaatgtcattgatatttttgatttcaatgggtcagtcattccaggtttacctcgctttatttctggaaatgacgtgcttttggtcggcaacaagcaggacattttacccaagtctgtcaagacaggcaaggttactcagtggttgaccgagcgggcacatgaaatcggcatgcgaccggttgatgtggtcttgacttcagcccaaaataagcaggctatcaaggatttgattgaaaagattgaacaacaccgcaagggacgggatgtctatgtggtcggcgtgaccaatgtcggcaagtcaaccttgattaacgctattattcaagaaatcacaggggacaaggatgtcattacgacttcacgtttccctggaacgacgctggataagattgaaatccctctggatgatggttcatacatctatgacacgccaggaattatccaccgtcaccagatggcccattatttgacggctaaaaacctcaagtacatcagccctcgcaaggaaatcaagccaaagacctaccagctcaatccagaacaaaccttgttcttggctggtctgggacgatttgactttgtggctggtgaacgccaaggctttacggccttctttgataatgagctccaactccaccgcaccaagttgcagggagctagcgagttttatcagaaacatgcgggctcacttttagtgccaccaaccagcaaggaattgaaagaatttcctgaactggtccgtcatgaatttaccatcaacgagaagacggatgtggtcttctcaggacttggttggattcgtgtcaatgaaaaagccaagattgctgcctgggctcctaagggtgtggatgtggtcattcgcaaggcgattatctaatactcttcgaaaattaaaagcagacgttgttgacttgatttgatgaactccagttctatctgcatctgcgtcgcctagtctgattttaattttcattgagtataagaggtatttgatttcagtttttacaattaaagagaaaggaagttcaagtcttctgatttgaacacgggctaagtatatcggcgcaataaggaaaaactttgttttctttatttcccgattgtaacagtctcccagtctgttacaacgccctttgtgtataataaattatgctaacttcaaaacaacgtgcctttttgaacagtcaggcacacagtctcaaacccatcattcagattgggaaaaatggtctaaatgaccagattaaaaccagtgttcgtcaggcactggatgcgcgtgaattgatcaaggtgaccttgctacaaaatacggatgaaaacatccacgaagtagctgaaatcttggaagaagaaatcggtgtggatacggtccaaaaaatcggtcgcatcttgattttattcaaacaatctagcaagaaagagaaccgtaaaatttccaaacaggtcaaagaaatctaagaaggagagcctatggctattgaactcttaacaccctttaccaaggttgaattagaggttgaaaagaaagaaaccaatcgcaaacaagtggggattctgggagggaatttcaaccctgtccacaatgctcacttgattgtggcagaccaggtccgtcaacagttgaagctggatcaagtcttgctcatgccagaattcattccacctcatgtggataagaaagaaaccattgacgaataccatcgctattccatgctcaagatggctattgcaggtattgagggcttggggattgaaaccattgaactagaacgccgtggtgtcagctatacctacgacaccatgaaattgctgaaggaaaaaaatcctgatacggattattatttcatcatcggtgcagatatggtagactaccttccaaaatggcataggattgatgaattggtccagttggtgcagtttgttggtgtccagcgccctcgttacaaggcagggacgtcctatccggttatctgggtagatgtgcccttgatggacatttcctccagcatggtgcgtagttttatcaagcaaggacgggtgccgaattttatggtgcctcatgaagttctggactatatcgaagaaaaaggactttaccaatgattgcagcagatttgacatttgatcgtcaggctcttttggaaaaaatccgtgtagccatgaagccagcgcgcttccaacatgttttgggtgtggagcaggcggcgcttgtcttggcagaccaatatggctgtgatccgaaaaaagccagtctagcagcactcttgcatgactatgctaaggaagtggaagaccaagtttttttggacttaattgccaagtatgatttggacaaggacctgctcaactgggataataacatctggcacggtgtggttggcgcctataaaatcgcagaagattttggtttggaagatgaggagattttccaagccattcaacgacacaccgttggggcggggcagatgaccttgctggacaaggttctctatgtagcggactacatcgaacccaatcgggattttcctggggtggacgaggcgcgtcgtatcgcaaaagagtccttggacaaggcagtagcctatgaaactgcccaaaccatttcctacttagccaagaaggggattcccatttatccacaaattttggaaacctataatggctatgttgtttggttgaaggagtagggatgattacattatagtcatttagtttttcttttattacttcgttaactcgctttgccgtactccagtacagcctgcagctcattgcctagtactaaaagtaaactaaaaggctataaaatatcttgatgaacgttcctatcaagcagtcttagacttgacagtagccgaggaggacaagggcttcgtggctccaaacgtgcgttccttggcggatgcctggttatatagagagaatgggagtgggaaagaactcgatgggttctaaaagagttcgtcaacaagtccttatttccagttgttgagctgaaacagtctatccccagactgtttcactcccaccccccgcacagctcaaactgtctgggagacagtttgaggttggagatgaagcgaactctgttcgcatcagtcgtagaggccagatttggagtgtgtagcacgaacaaagctgccaatcaaccactgcgctgagatgttgactagaactttgagaagtgtacttgcactagaaccttgccccttatgccatctgggcggatgaacaggtggttggttttgccttgattgacattgatgaagacatccagcagtatatgctctggcgatttatgattggccaagagtttcaaggaaggggctatggccaggcggctttggaagtcgtaatagcaatggctcaatcacatcctgtctgcgaccatttgattgcagcctatgttaagggcaatcagaaaatggctcatctcttggagaaaaataattttgtcttggatagtgaagaagaaagagaattggtcttccgtttggaaacgcctggtgttcagctatgaaatctgcattgttagtcattgacattcagaaccttctagtggaggaaaaaccttatgccattgaagagcgattagccctctggtaagatagccttgcacaagcccgtcaagcggggctagaagtcatccatgtccgccatcatgatcaggaattggtcaaggggactgcttgactgggagattcactcaattgttgcacccttagctagtgagaagattttcgataagtcctttaacagtgccttcaaggaaacggggcttcatgcttatttgcaggaaaaggaaattgagcgactcattatcatgggcatggcgaccaatttttgcattgatacgacgattaaagtagcctttgaactaggctacaaggtagctgtgatccagggcggaacgacgacaggttattcaggtaaattggacgccgaagacttgattgaccactaccaaaacatctggtcatggaattttgcccaggtggatagattagaaaatataattagaggataagatgaaagaactagatttagtaaaagttgtggttcaggctgctgatgacaagcgagctgaggaccttgttgtaattgatgttcaaggcgtgaccagcctgacagactactttgtgattgccagctccatgaacagtcgccagttggaggctattgcggaaaacatccgtgaaaaggtagcggatgttggaatcaagagtagccgtgtagaaggcgatagtaacggtggctgggtcctattggatcttggaggcgtagtcgttcatatcttctcagaagaaatgcgtgacctctacaaccttgaaaaattatggcacgaaggcagcttcttggaagtcgcagactttttagaagaggaatagtgaaacagtttggggaactgtttcagctggtcaccataaaactcgaaagtgaccaaagagagttcactattatgtaattagaagtgatgaacttcttgaaaaaatatgaagatagattttgatttgggtgcactatttgaaacttaagtcaacatctcagcgcagtggttgattggcagctttgttcgtgcttcccactccaaatctgacctaatcaactgtgcgggggcaggaaaacgaactctttggaattgaggagttctttcctgctccctttttatgaaaggaaaaatgggaaaatatggcaacttatgaaacatttgctgcggtctatgatgaaatcatggatgacagcttgtatgataaatggacagattttagcttgcggaacttgccacaagacaccaagacaattttagaattggcctgtgggacagggattcaggctgtacgttttgctcaaaagggctatgaggtgacagggcttgacctgtcctatgaaatgttggaattggcccagaaaaaagcagaagctgctggtgtcatgatggaattggcccaagcagatatgatggctctggaaggtgtgggagatttcgatgcggtgacctgttattcggacagtctgtgctatatgtcggaccgagaagccgttttgcgggtctttgaaggcgttcactcggttctcaatcaaggtggtactttcctttttgacgttcactccatctatcaaatggaggaagtctttgcaggctatagctaccatgaaaactacgaggattttgcctttgtctgggacacctatgagggggagcatgcacattcgattgttcacgaattgaccttctttgtcaaagatgaagccagtcaagaggagcggtttatccgtcgggatgaagtgcatgaagagcggacttatccgattgaaacctatgtggaattattgaaagaagctggttttgcatctgtggaagtctttgcggactttgaagatgaagcaccgacagaaacaagccagcggtggtttttcaagtgtaaaaagtaagatttaaaattaaagtgaagttttcgggtcccaccaaattagagtgggattttgtgatataataaaaataaatatatctgtaaaggaaaatgacatggagagtttacatcgtaaaatcagtaactggggtcaaaaaatattccttcagttcaaaaatagaactcctaatgtggaagggataagttttaatagactgacctctaataaaaatatagatttggaaagggaaaatccaagctttaaacaagcactagattttgcaatccaagatgatgagttaaaaaatgtagcgatcacgggaaattatggctctggaaaaagtagtttgcttgattcttatgaagcgaagtactctaataaaaaattcctccatatttctctagctgactataaagaaaatgatttatcaggctataaagaaaatgattcatcagagtcaggaaagaaactaaatgtacgacagattaatgtgattgaaggcaagatcataaatcaattacttcatcagattcatccaaaacatgtaaagaaatcgatttttaaaacattgtctcgaactccaagaagaataccgcttttattaactgtatatattgtactattcttcattacactttcttattttttgaaacccaattttttaaaagctttagtcactgctgacaaggtatttgggtgggatgccaataccgtatttagctggttatttttgattcttctttttattggctcccttacaacgatttggtatatagttgaaaataagacgataaaatcattgacaattggtggcaaaaatgtttcatcagagattgatattttttctgatcagtcgatgagagtttcctattttgacaaatacctagatgatgtgttgtatcttttgaatgaatcaagagcagatgtcattgtttttgaggatatcgaccgttttgagaataacactatttttgccaagattaaggaactaaacgtattagtcaacaataagcgaaaaatagctaagaaatcatcaaagctagtgtttctttacctgatacgagatgatttattcatttcaaaagaaagaactaaattttttgattttatcatcccagtccttccagttattacgagttcaaactctagcgataagttgacaactactttaaaagaaatgggaataaaatcaggattagcggatgacttcctcttcagaatctcgctttatatagatgatatgagattgcttaataatatctgtaatgaattttattcttatcagcttgaattgacacatgacaagacgggtgagaaaaatgcattggatcttgatttgaaaaaaatatttgcaatgattgtctacaaaaatattttcccgaaagacttttctgagttgcagaataatcaaggttttctatattcattgtttaatgagaaagaagttagaagaagtgaaaaacttacgaagattgatagtgaaaaactgcatttagagaataaactgagaaagattcagagtgagcacattcaagatgaaattgaactctatggaacaatttttaaaattccaaatgggagaaaggttgtcagtgtcaatgacaaatttcaagatgagtttacttcttatcatgattttatttctgaaatgctggtggaaggaagtcgtatcatctcctatgtggattttgatgatgcttaccgtaatgtaggtattaaaacagaaaatatggattcaatttttccagagaaagattctccagagtttaaggaacgccttgatactgtaagaagtcgcaataatagtaaagagttgcaacaaaaaattgcttcattaaatcaaaaacggagctttgttgaaaaacaattgattgcggacatctatactaatcaagaaatacatgaatttgctaagagtagagaagaatttattgatatagaaaaaaatcagcaatttgatattatttacttcttattgaaaaactcttatatagatgaaacctatccagattatttgacctatttttatggcaatgtcttaactaagaatgataaagaatttttgagaaatatttccagtggaagaggtgcaggttttgatttcagactggtaaatatttcaaatatctatcatcatttgcaattaaaggactttagaaatgaagaagttttaaattttgacttgattgaatacatgcttaaaaatttggagttgcagagtcgagaagaaaacttgagtgctatcttattacaagaagataacttggattttttggttgaactggcaaagaaattgtatgatagtaagtctgaaaaatataacttggaacagtttgggcagttgatggagttttggctatctactaatccacaaagatttattgactatatgaagtctacgaaggtggagtatcaagctccactaaagaataagttcattcgagctttgatgaatcaggtgaacttagatagtgttgataatgaaataaaggcgttagtagctcgttatatcaatgaaaataatgatttaatttcaccaaatgaagattttacatcatttttcaaaacaaaccttaaggcaatcaatcttaaattcactcattttagagagcctgatgatgatgctcccagaactacgaccttcttggagcttatcgactttatctttggcaatagtttgtatgagataaataaagaaaatttaagattttttatgcggtggtttaagggaagtactgactggtcagaggaagacttcaagcacaagaattttgaactgcttcatacaaatgataattattcaccgctgctagagtatagtagattgaagataacagactatgtctatgcatatttagagatttgtgaggggactattttagataactcggaatatattgtagaactacttcaaagaaacgaagtttacgagtctggatttaatttgggaacactggaggaagaacgccaaattgatagaattttacagttccttccggataatagtattaatttcaatagcgatgatttccgtcaacttgtagaagaggatattcttgaagaggggaattatcttaccttgctaagtttactagttcaaacttctaaagccgtagtggatactgatattatcttatcttattttaccgagaatcagaattatgataatagtcttatcaactttatcaataatgcaagagatttaaaatttgaagaggatatatttaacttacttgagaaagaagaacaaagaaactttttcaccaaaactgttgagtgtatggagttagatgacaccaaatatgaactcatacttagcacacttggttggcactataccgatacatttaataaaagtggaatagagtcaagtaagcttagaatattaattgatttggaaattatacagtttaactctaagaacattgaatttttcagagataattatccagaggatacactatacctaatcaagaaacacttatcggaatatctagatactaaaagtaaaatatataaggaagatgagttgttagcattacttgatgatgacattatttcggatgatgagaaaactaacattgcagaccatattttaaaaatcagtataaaaaataaacagtattcagaaaaattgactgctcatattttggaaaatcagtttgatgaagaggatttgagttatatcatcagtagtcaattctttgacaaccagtcactgagtttgaaagagctagttaaacaaattgcaattgaaaatcttgatactatagctgaagaattttatgcccaaattagtaataatttaatgagaaagctaatcgctgaaagtcaattaaatacattaaagaaattaatttataattactatgtatatacaccaaatttggatgagaatgagaagcgagagcagttttctaagtatttgaatctatttgctctatcggataatattacagctttaaaggaactcaatgtatttgatgagtgggatagtgtattgaaaacattaaataaaccagggactagatggggacaagtgcaaaaaacaacaataaacttggcatttgcaagatacttagatagtaataattttgtaagctcaattaacgaacgaagtaacgatatccgcttaaatagctacaaggataaaactatacctttgtagacctatgttagactatgatagagttgtcgaattaaaatacaaaaaataggagaaatgcatgtctatttcagggataatagcagaatacaatccctttcacacggggcataaatacctgctggaacaggccgaggggctgaaaattgtcgtcatgtctggcaattttatgcaacggggtgagccagccattgtggataagtggacacgggctcagatggctttggaacacggggcagatcttgttgtcgagatgccctttttggtgtcggtccagtcggctgaccatttcgccaagggagcaatcagcattttacacaggctaggtgtggaaaaactggttttcggtacagaagaaatgctggattatcagaaaattgcggatatctatgtggataagtcggaagagatggaaaattttgtgaaaaacttgccagacaatttctcttatccacagaagacccaggccatgtggcaggaatttgcgggtctaaccttcacaggtgatacgccaaatcatattctggctctggcttatgctaagggggtggctggaacaggcattcagctcagccctgttcaacggcagggagctggttttcattcggaagaggtggaaacgtcctacgcctcggcgatagctatccgaaagggtgctgaccagctggacttggttcgtgactttttaccgtctgccagtctctttgaagaggcgaccaaggtaagctggagaaactattttcctctgctccgctaccagattacgacccacccagatctcagtcaggtctttcaggtgaacgaagaactagccagtcgtatccgctctgccattgggagcgtagcgaccgtggaggagttagtggaggccgttacgaccaagcgctacaccaaggcgcgggtgcggcgggtgttgacctacatcctgattaatgcggtggaaactcccttaccagatgcggtccatgtgctaggcttctcggctcgaggtcaggcctatctcaagcaggtcaaggagcgagtgggcttggtgacgcggatcggtaaagagccctgggacagcctgacccagcaggcggatttggtctatcaactgggcgctgacgcaatggcagagcagacctatgggcgcgtgccggtgagggtggagtgagaatctgagttgaaaatagaaaatttttataatttttcccttgactctaacgctgggtcatagattatactgctatttatgagaggagattatccatgaaaacagtgaaggaaatgagtcagctttcaggtatcagtgtgcgcacacttcattattacgatgaaataaatttgctgacacctagttttattgcggaaaacggatatcgttactatgataatgaggcgtttgaaaagttgcaagaaatcttactttttcgtgaattggaatttcctctcaaagaaattaaaaaaattgtagggaatgcagcttatgatagagagtcagctttgaaagaccagattagattactggagttgaaaaagaagcacttggaaaaagtcataaagcatgccaagtctttacagcagaagggagaaaattacatgaattttgaagtgtttgataagtctgatttgttggctttccaggaggaagctaaagaaagatggggtaataccgcagcttttcaggagttttctgctaagacgaatcaggaagggtttgctcatataagtgcagaaatgtctggtattatgatggaatttggaaaaatgaagagtttatcagctgatgattctaaagttcataaacaggtagaggttcttaaagcttatattagtgagaatttttataattgtaccaatgaaattctagcaagtctaggacaaatgtatattgcagataaccggtttactcaatttattgatcaagtgggaggagaaggtacagcgtcctttgtcagtcaggcaatagcagtttattgcaaagaataaacgaaagaagtctagtgagaactaggcttttttagtattatgaaaacgctttatatatggtataataaaacatagaataaagatggggatctagtatgacaaagataaaaataatcagcaatccatttcataaaagtattgtttttcaaaagcaacaaccgattacagaagtttgggaggaaattacatttgaatccaatccaaatagtcgtttggtaagggaaaatattcaaaaaggggtgctatcatttcatatccaagaaatagtagatattctggtggcagaatatgatgatggaacagggattgacttgttatttgaaggaaatagtgatgaatttcaggagttgaaaacatttgtccaatcgttaaataattcttctatttctttgaagaaatctgcttatagcttgacaaatgcacgagatattctacctgaagttctttctatttttgataaaactcaggtcattcttcctgaagaacttgaacatgacgcagccatacaaaagtttcaagatgcaacaaaacctcagattccattattggttttgggaaattatagtgcagggaagtctacttttatcaattcattggtaggatatgagttattgcctgccagtgaccaacctacaacagcgaaaattatacaaattgagaaatttgctgaaaaatggattgaaatagaaggaacacttctaagaaataaggtttgtatccgaattgatgaggacggctttgaggttgaaggcgacaggattgatgagacaattatcaaagatttagaatccattcgtcagagtttgccacaaacaactccgcaaatactagcacgggctgtgttggcttatttgaatgctagggaagatagtgatttgaatattatcactgtgaaaacagcgtttaccgatagtccactgtcaaaatcttctcatcgctacatcatatttgatactccaggttccaattcttcgaccaatatggagcatttgcagcttcttcgtgaggctatggcgggtatgagcaatggtttgcctatttttatatcggaatacactagcttagatactgtagacaatgataaactctatcaggaattagaacaaatagacggaattgatttacggtatacaatactagttgttaacaaagcagacactgcggccttatcaacttttcaagatcatcaggtattaaatcaagcccttccaagaaaattatcaacaaaaagagtttatttcctatcctctctaatgggcttggggtcaaaaaccagcggtcttttccaagagccagattatgagagagtttatcaaaaaagtttggctgagtttacagacgcttcaaatccttattatcaacagttgtatacttataatattcttccaactcagcagaaactggctcaggaattgcagtctaaggaggagagaaatcttctctatgccaacagtggactgtacagtttagagtcggaaattgaggttttttcaaccaagtatgcggcttataataaatgtgtacaggcggaccagtatttgcagcatattatttctcaaacgcagtcaatcattgaagattccaagaaaacaattgagcaagaaaaagatcgtttagagaaaaagttggagaaagacaagctggcattggtgaatgatttaaaacgccaacaagctgattttttcaattcctcatcgacggtataccaacaaaacttgaatgagaaagtaagggatgagaaacattatgctccgttacaactgttcataaaagagcgggactctctatggagtaaggcagttgatgattttcaattgaaatcctatcaaaaagaaatggcagaatctcctaagaaagccctaaacaatatcaagaatagtttaggaaaagcctgggataagaaaaatattgaaatcctaggttcagcatttgtaaatggttttaacgatacgggaaaagtgttttcgaaggttgatgactataataaaatgaagaccaaggccaaaggtcaagttcgggatcagttaattacttttgcaaggtttgaatacattaaacaagtggaagaggttggaaaagactttacgactctgtcaattcattattggaaggagcagacaggattgattaaagatagattttctcagctcattggtgatgcgtccgtattgtcagatcaaaagcgggcggctattaaagaaatcattttccaattccagcagccagttttgtaccatgattccaagcaattatttgatcaaaaatcattggtagaaggattccgtttgggagacatccagatatttggtgatgccaacaagatcgatttacaaaagctagaaaaacgctataatagtttgttaaaaactgcttacaagcatatcaatgagcaattgattagtcaccatcaagcgactttttataaatgggttgaagccttattgcatttggtaacggagaatattgtagagtttagtccagaccttcattctacgaatttgttaatacaggacaaccgagtgaagattgaggaattatcaaccaacttgcaaaatctacatgagtattctaaggacttgcacgacttgatggcatggaaagatgatgaggaagtagcaaatggttattaagaagatgataaaaaaagtagctaccaaggcagcagacggtgtttcaaaattatcagaattgagtccagagcagcttgaaaaagtgcaggctcaaatggcgacttatcgggatcaaattcctgatttgtcaggtgaggctgcggaggaatactttaggaaacagttagcaattgctggcgtagaagtctataatgcctatctacctcagttaaaagacctttatcttccgattgacaataaaacggaatttcgtttagaagatgagggagttttgatcgatgaaggcgaatttaagagtggttataatatccgctacatcaacattaccaagtgggtgacggataagcaggaaaatagtttggagaaactggtcagtgtttatgaggtcttgtcaacaactccttgtaatatttctcttgttttccaccgtaaacaggaggaaacatctgtatatttagcggtcactaacactgaaaatgcggatagtaatgcagatgttgatagttaccgcaagcgattggtctcagctatcaagggaaattttccaggtgcagcttggaaagaggaggttggaagaggtagcctgccttgttttgaggactatattccctactcagtagcaacagcttctaatattccaacggagaaatcagagaagttcatcagtcagacaatcgaaaaattattggatggcattgtacctgaaaacaaagaacaagaatacattcttgtcctcctggcaacgccagttttggatgttacagatagaaaattgcatctttctcagatttattctaacctatctccttatgccacttggcagacccagttccaattgacagaatcagattccagaggctcttctgcaactgttggggttaatattggtgccagtgtcggaagccagacaggtcacaatctaacccaaacccattcgcaaggtcaaactgagtcaagaggaactagtgagacggagaccaataccaaaggaagtggttggcaagcaggtgtaaatattaaaatactcaacggaggtcataattggaacaaaagcaaatcaatcgccaaaggcatcaccaatacaataggcaaaacagcctcggttgccaatgccgttgggaaaacagtttctagcagtctaggtgccaattttggagctaattttgctcgaacttccagtgtgactgctaccattgggaaaaatgaaggcattagtcagtcctttgtcaaccaccatgttcagcacgctctaaaaaatttagacaagcagatggagcgtttggaattgtctactgccttgggactatgggatttttctgcctatgttttgagtgaagatccaactattgccaataacgttgcccattcctatttggccttgactcagggagaagaatcgcatctgtcgcaaacagttgtcaatctttggcgtggggatgttcaaatggaacgtgataaggctaaagcactgattgcctacttgagagatttacgccaccctctctttggtttcaacccagaaattctagagattgatgaagaatttgcagtttatccagaaatcgtcacagcagccacgccactgtctggaaaggaattagcctatgctctcaattttcctcagaaatcgattgccggtcttcctgttttagagtgtgctcagtttggtcgtaatatctctacttttgaggagaaagatgatcaggagcaacttcctttgggaaatattttccacatgaatcatgaggaaaatacagcagttcagctttccttaccttccttggcctcccatacatttattacaggtagtacaggtacaggtaagagtaataccgtctatcaattgctcgctcaggctagggaaaaaggaattaaatttttggttgtagagccagctaaaggagaatataagcaggtttttggctcagatgaggatgtggcagtttttggaaccaatccaactatcactcccttattaaaaataaatccattcagcttccctgaaggcattcatatcctagaacatttagaccgtcttgtagaactcttcaatgtttgttggccaatgtatgcagcgatgcctgctgttttgaaaaaagccattgaacaagcctatcaagattgtggctgggatttgatttcgtcagtgaatacttattcaaaaaccattttcccaacgtttgcagatgtcttacggacaatcagagaaattatcgactcgagcgaatacgacaatgataataagggagcctataaaggagctttgctgacacgcttggagtcactgacaacggggatttaccagttgatgtttacagaagatgagatttcatccgagaagttatttgatgaaaatgttatcgtggatttgagtcgtctgggttctagtgagaccaaatcgctgataatgggtctcctcattttaaaaatgcaagaataccgaatggtttctagtcagggtatgaatcagcagctccgccatgtgactgttttagaagaggcccacaatctcttgaaacgtacatcaacagaacaggcaaccgaatctagtaatttacttggaaaaagtgtggagatgttgaccaatgccatcgctgagatgaggacatatggagagggctttattatcgcagatcagtcgccaggtctcttagacttagctgttattcgtaataccaataccaagattattttgcgcttacctgaatattccgatagggagttggttggtaagtctgctaatctaaatgaagaacaaataaatgaattggccaaactgccgaaaggtgtcgcagcagtctatcaaaatgaatggctggaaccagttttatgtaaggtggcaaagtatgactcaactgaaatggtatttcaacaaccaacccaattagtaaggacagaatcaccctatcaccgcttggctattttagaattactgactactagcccaaacctagatagcaccttgtcttttgaagaattacaagaattaactctagcagtaggtcttgatagtttgactcaagtaagaatctttaacttcttacgaacaacatccccagataattttagtatgcatgaactggcgcacattctcgggaaagtatacccagaattagtcgagaaaattcggttgaaagcagaaaaagggttagagccacccgctttgacacaggtacttcagcaggaaattgacagtagtatacctgagacgatcagtgagcaggccagacgggatttagtacagggcttgatgacttgttattatttatttgaactaaaagaccacaaggccatgcaggattggttacgaaatggagacttaatatgatagaaggattgaaaactgttgcggaggcagttaagcctgtcgtaaatgaagttggcaaacgagcgatagatgcctttgaaaagccgatagattcagataagcgattggaagctgcatctgataataaaaccacttttcgctatgatggtctgagcaagcctcaagaatttctagctcaagcccaagggtttcccaaagagatagctaaggatatttacaattctcaggaactcaagcattatatggacataggaatgcgagctgtgcaatttggacagaaagaaaatggggagccacgattttgtcttattccaaaagatttatcgtttgatagagttgtagactcacaggggcgaaccaacgcagagcgattgcaaagtggattactaccgataaaggatggtcaacctttagaagttcaccatatcggtcaaaaaaacggtggtcattatgccttattgacgaaagaagaacacattaagaatgggaataaagaaatgttgcataagccaggtaaatctgatgttgatcatggtttagattttgctagagataagcgatcaattgctaaagtacttatggaggaacaagtatgagtcagttagtagataaaataaaagtagtccaaggtctttatagcggtagccctgctagtgagcaagaagtggcagtggctgagagtaagcttcagttgatatttccagcagagtataaggactatttgaaagagtatggggtgatttcattctatggaacagaatggaatggattgaaaggagatacttggaccgatgtagttgcaaccaccttggaagcgcgtagtctgtatgaaaattttcctaaagagaaatttattttagaggatctacattttgatgatatgcttgttttagcggattcgactggtaaagtctttttgtggcacaatggattagaaaaagagattcattcctcaattgcgtcctatctggaagaatgtgtagccagaaaggacaccccatgattcaacctattatgaaagatattttcttcctgcagcagaagtctgagcctgcgactcagctagatgtgcaggtcggtcaggacttgcaggacactttagcagccaatgctcatgcctgcgtgggcatggcggccaacatgattggcgtcaaaaagcggattatcatcgtcaatatgggttttaccaacctggtcatgtacaatcccgtcctcatcagcaaggccaagccctatcagacagaagagggctgcctgtcgctggaaggtactcgcccgacgacacgctatcaggagattgaagtggagttttttgatgcttcatggaaaaagatcagcctaaagctgacagacttccaagcccagattgttcagcatgaactagatcatttggaagggattatcatctaaatctaccgtcaggtagatttttttgtataaaagtcaaaaaaggtcaaacaaaactattgacttttactgaccaatgatgtaaaataagattcgtaaggtaaagggccttacaaattctttgaacaaaaggtcagtttaggtcaaacaaaaaagtttgaccgacaaattgactaaatggtcagtaaaagacaaacttctaaggaggttgctatgaaagacaggattataccctattaactatttttttatcacaaaaaggtcagttttggtcaataaaaacataacatgaaacgaggtaaaaactatgaacaacaatttcaataactttaacaatatggacgacattttcaatcaactcatgggcaacatgggtggctacagcacagaacgtcgccgttattctatcaatgggcgtgaagtgacaccagaagaatttgctatgtaccgtcagactggtcgcctgccacagacagaagaagtggctcaaacacaggctaaaggtcagataaagtcagacggaattcttgcaaaacttggtcgcaatttgacacaagatgcgcgtgaaggtaagttggatccagtcattggacgaaacaaggaaatccaagaaacctctgaaatcctagctcgccgtacgaaaaataatcctgttttggtcggtgatgctggtgtcggaaagacagcggtagtagaaggattggctcaagccattgtcaatggtgatgtgccagcagccattaagaacaaggaaatcatctccatcgacatttcaggcttggaggctgggactcagtatcgtggagcttttgaggaaaatgtgcagaatcttgtggatgaagtcaaaaaagctggaaatatcattctcttctttgatgaaattcatcagattttgggagctggtagcactggcggagactcaggttccaagggtttagcggatattctcaaaccagctttatcccgtggggaattgacggttatcggtgccactacacaggacgaataccgcaatactattcacaagaatgctgctctggctcgtcgtttcaatgaagtcaaggtcaatgctccgtccgcagaggacacctaccagattttgaaagggattaagccgctttatgaagcccaccacaatattgaattgccagatgaggttttgagagctgcggttgattattccgtccaatatattccacaacgtagcttgcctgataaggctattgacctagtcgatgtgaccgctgcacatttggctgcacaacatcctgtgacagatattcagaccttagaagcagaaatggctgaggcaaaacagttgcagttggaagcagctgaaaaagaggattatgaaaaagccttgaatgaaaaagtccgtattgataagctacaaaaacagattgataatcatacggagcaacagaaagtggtggcgactgttaatgatgtggctcaggcggttgagcggatgacaggaattccagtctctcaaatgggagcttctgacattgaacgactcaaggaattgaaaaatcgtctggcagcaaacgttatcggtcaagacgatgcggtggaagctgtatctcgtgccattcgtcggaatcgtgcaggttttgatgatggcaaccgtccaattggttccttcctctttgttggtccgacaggtgtgggtaagacagagttggcaaaacagttagcactagacttgtttggtaacaaggatgccattattcgtttggatatgtctgaatacagcgatcggacagccgtttccaaattaatcggtaccacagctggctacattggctacgatgacaattcccatactcttaccgagcgcgtccgccgcaatccgtactcaatcgttcttatggatgagattgaaaaagctgatccacaagtgattacccttctcttgcaagtgctagatgatgggcatttgactgatggacagggcaaccaagttaactttaaaaataccattattatcgcgacttctaatgcaggttttggttatggaatggcagaaggtgaagaaaatcaagacatcatggaccgcatcgcaccattcttccgcccagagtttctcaatcgttttaacgcagtcatcgagttcaagcatttggataaagatgatctcaaagccattgtagaattactcttggcccaggtcaataataccctggcgaagaaaggcatccaattaacggtaacggaagctgccaaagaattcttgatggaagaaggctatgacaaggccatgggagcccgtcctctgcgccgtgtgattgaaaatcagattcgtgataaggtgacggatttctatttggatcatgttgatgtcaaatatctggaagcggatgtggttgatggaagcatccaaataaaagagcaaagctttgcttaaaaatagtgaagaatttgaaaaatcggatagaaatatctgattttttcttttttgttattcgctaacaaatgctataaaataggctttctagagcacattaaaactttttttataaaatccttgacaagtgcaaacgtttgcgttaaactatattcgtaaccgacagaaaggaaaacgtttttatgacaaatcgtaccagtggaattttgatgcatattacctcacttccaggtaagtttggtattggtacttttggacagtctgcctatgattttgtagatttcttggtggaaaccaagcaaacctactggcagattttaccactaacaactacaagctatggagattctccttaccagtctttctctgctattgcaggaaatacacacttgatagactttgacctcttggttgaagatggcttattggcaacagaagatttccaagatgtaaattttggagataatcctgaaaaagtagactatgctcttatctatcaagttcgtcgaccaattttggagaaggcagttcaagcatttttacaagatgataagaagaaagctgcttttctagagtttgaaaaggctaactcatcttggttgacagattatgcggagttcatggctatcaaggaatactttggtaataaagctctccaagaatgggaagataaaaaagttgtagctcgcaatgaggaagctcttgataagtaccgcttagaattggcaaatcaaatcgactactacaaagtcacacagtatttcttcttcagccaatggaaacaattgaaagaatatgccaacaaacaccacatcaaaatcatcggagatatgccaatctatgtttctgctgatagcgttgaagtgtggacaaaaccccaactattcaaattggacagtgaacgcaagccgctttatgtagcaggtgtaccagctgataacttctcggcagatggtcaattatggggaaatcctatttacgattggccagaacatgaaaaaacaggctataactggtggatttatcgtatccatgaaagtttcaaactttatgatgtccttcggattgaccatttcaaaggtttctcagacttctggcaagttgatggtaaggcagaggtggcaaaagttggaacttgggaaccaggtcctggctacaatctcttcaaggctgtcaaagaaacacttggagaccttccaatcattgcagaagaccttggaaacattgacgctaaagctcgcaaattgcttgcggattgtggctatccaggcatgaaaatcttagaatttggtttctttgatgtaacaggtaagagtatcgatgctccacaccgttgcattccaaattcagttgcctacactggaactcacgataatgaggttgtcaatggctggtacaacaatcttgatccagaacaacaagaatacgtggatgcctacagcaaccgtaagccgattgaaaaagttagccaagctatgctccgtatgctgtttgcaacagtgagtgatacagctatcgcaaccatgcaagacgtcctagacttgggagaagaaagtcgaatgaatatgccgtcaactatcggtggaaactgggaatggcgcatgaaagctgaagacttgacccaagaacgcaaagacttcttgacaaaaatgacattactataccaacgaggaaatgaaaaccatgactaaatttacaacatttgcagaaacaaatacttcgaagaaattagctgatttgacaaatgaagaaatctatcttcaactgttgaactatgtaaaagatgcagcagcttcaaaaccaaaaaacacaggaaaacgtaaagtttactatatctcagctgagttccttatcggtaaactcttgtcaaacaacttgattaacttgggtgtgtataaagacgttcaagcagaattggcagcagctggtaaatcattggcgcaggttgaagatgttgaaccagaaccatcacttggtaacggtggtttgggacgtctagcttcatgtttcgttgattctatgtcaacacttgctatcaacggtgaaggtgttggtctgaactaccactgtggtcttttccgccaagtatttaagaaaaatgagcaagaagcagagccaaacttctggattgaaaatgattcttggttgattccaacaactatcagctatgatgttccattcaaaaacttcactttgaaatcaaaattggatcgtcttgatattcttggctataaaaaagagactaagaactacctcaatttgtttgatattgagtcagtaaactatgacttgattacagacggtatttcatttgacaagactgatattaaagaaaacttgacactcttcttgtacccagatgattctgataagaatggtgaattgctccgtatctaccaacaatatttcatggtatcaaatgctgctcaacttttgattgatgaagcaattgagcgcggttcaaacttgcatgacttggctgactacgcttatgtgcaaatcaacgatactcacccatcaatggtgattcctgagttgatccgtcttttgactgaaaagcatggtattgaatttgcggaagcagttgccatcgttaagaatatgactggttacacaaaccacactatcttggcggaagcacttgaaaaatggccacttgagttccttgaagaagtggtgccacacttggttgatatcatcaaagaattggatgcccttattcgtgcagaaattaaagacccagcagtccaaatcattgatgaatcaggtcgtgtacacatggctcacatggatatccacttctctaactcagtgaacggtgtagctgcgcttcacacagaaatcctcaaaaactctgaattgaaagctttctacgagctttatccagaaaaattcaacaataaaacaaacggtatcactttccgccgttggttggaatttgccaaccaagaccttgctgattacatcaaagaattgattggcgatgaatacttgacagatgcgactaaacttgaaaaattgcttgcctttgctgatgacaaggaagttcatgctaagttggctgaaatcaagttcaacaataagttggctctcaaacgttaccttaaagacaacaaaggtatcgagctggatgaaaattctattattgatacacaaatcaaacgtttccacgagtacaaacgccaacaaatgaatgccttgtatgttatccataaataccttgaaatcaagaatggtaaccttccgaaacgtaaaatcactgttatcttcggtggtaaagcggcacctgcctacatcattgcacaagacatcattcacttgattctttgcttgtcagagttgatcaacaatgacccagaagtaaataaatacctcaatgttcacttggtagaaaactacaatgtgacagttgctgagaaactcatccctgcaacagacatttcagaacaaatctcattggcttctaaagaagcgtcaggtactggtaacatgaaattcatgctcaacggtgcattgacacttggtacaatggatggtgccaacgttgagattgctgagttggctggtatggataacatctatacatttggtaaagattcagataccatcatcgacttgtacgataaggctggatatgtatctgcggactactacaatggcgatgccaatatcaaacgtgcagttgactttatcgttagcgatgaggtaaaagcacttggtaacgaagaacgtcttggccgtctgcaccatgaattgatttcgaaagactggttcatgaccttgattgacttggctgaatacattgaagtaaaagaacaagtctttgcagactacgaagatcaagattcatggaacaagaaagttgttcataacattgccaaagctggattcttctcatctgaccgtacgattgaacagtacaatgaagatatttggcacagtaactaattgaattccaacaattagtaggaaagttgattgaaccactccaaaacttatcagatcaattcttcctatgtgttgaagaataaaaaccgaccagtttttaccattattggtactctccttagtatataaatgcaaagaatgtctctgcaaaagcagagacattctttttataactataaaattctagaagttttgtacacttgatcaaaaaaatcgaaagtttccttttaccgtttcgccattgatacaaagctaactttgtctggacggtaactaattgttccatactggaaagcttgaccatttgaaagataggtgatgctagtgaccacgacgaccatgtcatagtctcctaagtccatcaattgtttttcttcttcgtttgcaaaacggaaggaaatttcacgtctggaatgagaaattgttaaatggagttcttcttctaagtagcggtaaatagagctttcggcaatttctttgctgagataagggacgaccctacggtcaaaataggaaatgtcatattccaaccgctcaccgtcaattgtccgtacccgactcactcgatagaaatctaccttatcatcaacttcgaaagttgacattaaatcttcttgaccttgaataatataaagcgaagtaagctgggtctgaatttggtgctgtgatcttttgttcaattcgcccgctgttttaatttcagaaagatattggtccttcattagaccatgttcgataacaatagaagatttcccctgtttcttttgaatataaccatccatttcaagaagagatagtgctttgcgaatggtgtccttggagtaggaatacacttccattaattcattttctgtcggtagggcctgtccagttgaccaaacctgctcttcgatttttttcttaatatcttgataaacttttttatacttactcatagtttcctgtctttctacccattagtgtatcataaaagagctagaaaggggcaatacatctattttatttagtagaatatacaacttttacgtaaaagtttaaaatattacggaaaagctattgactaatgcaaacgtttacgctatactattcctataaaagaaaacggttacgcattttcagagagagggggagcaatgaaattactaacaattaatgtccacgcctggttagaagaaaggcaggatgaaaaactagatgttttagcccaaacaatagctgaaaaggcttatgatgtcatcgctcttcaagaggtcaatcagctcataactgctgatttggtaacgaaagacttgaaggcggataattatggcttgattttattagaaaaattaagaaccttgggacaatttgactattcatattattggagcaactcacatatcggctacgataagtacgaagaagggattgcctttcttaccaagttgccagtttatgaagtggatcaattttattgtagtcagaataaatctattgattccatcctatcacgaaaaattatgggattgacggtcttctatcaagaccagttgatcgacctgtattcttgtcacatcaatcttccagggagtgaagaggaagaccagcttgataacattcgtacgattgtggaacggactggcaatagacgttttaagattcttatgggagattttaataccgatgccttctcagatcgagaggcctacgaagcgattacagagctcggtctttatgattcatataatctagcgatggaaaaagaccaggggattacggttgaaaaggctatcgatggctgggctggtcacagtcaggaaaaacgattggattacattttcttaaatcagaaaaaggaagttttatccagcttagtgattttcaatggagagaatcgtccgattatttcagaccattttggtgtggaagttgaaattaatgtataaaatggcacagagccaaaaaataaaggagaaaaaatgaaaaaatttcttagtttcgaattttggcaaaaattcggtaagtgtttaatggtcgtgattgcagttatgcctgcagcaggtctgatggtttctatcggaaactctattccgttaatcagcccagaatcagaactcttgattcgtattgggaatatcattgcccaaatcggttgggggattatcggaaaccttcacttgctctttgccttggctatcggtggaagctgggctaaggaaaaggctggtggtgccttctcagcaggtcttgccttcatccttattaacttgattacaggtcacttctttggagtgacgactgacatgcttgcagatgcagcagcaaccgtaaccactgtttttggaacagagattccagtttcaggctacttcgtcaacatcttgggtcagcctgctctgaacatgggtgtcttcgttggtatcatcgctggttttgtaggggcaacaacctataacaaatactacaattaccgcaaattacctgatgttttgaccttctttaacggtaaacgctttgtaccatttgtggttatctatcgctcagttcttgtagcgctaggattagctatcttttggccagttgttcaaacaggaatcaacagctttggtaaatggattgcaagctcacaggatacagcaccaattcttgcaccttttgtttatggtaccttggaacgtttgcttcttccatttggtttgcaccacatgttgaccattccaatgaactatacatcacttggtggcacctatgacatcttgacaggtgcacaagcaggtacacaagtatttggacaagatccgctctggttggcttggattacagacttgatcaacctcaaagatgctggcgatatggctcagtacaatgaccttcttgcaaacattactccagcccgtttcaaagttggtcaaatgattggttcatcagggattttgatgggattgacttacgctatgtaccgcaatgtggatgaagataaaaaacataagtacaaaggtatgtttatttcttcagcacttgccgtattcttgacaggtgtaacagaaccaattgagtttatgttcatgtttgcagcaatgccactctatgtcgtttatgcttttgtacaaggtgcggcttttgccatggctgacattgtcaacttgcgtatgcactcatttggtaatatcgaattccttacacgtacaccgatggcgatcaaagctggtatcggtatggatgttattaactttatctgggtaacagccctctttgcggttggtatgtacttcattgccaactttatgattaagaaattcaacctagcaacagctggacgcaatggcaactatgatacagaaacaacggatgtggtttcaaactcaaacgtagatactgcggatgccaattcacaagtggttcaaatcatcaacttgcttggtggtcgtgataatatcgcagatgtggatgcttgtatgactcgtcttcgcgttagtgttaaagatgtggcacaggttggagatgaaaatgcttggaaacaggctggtgctatgggcttgattatcaaagactcaggtgttcaagcagtctacggaccaaaagcagatgttctcaaatcagacattcaagacttgctagaatctggcgtagccattcctcgtacggaaattgttgcgacagaagaagttgctcctgagactcagttcaaaggtgtgacggagacagtctactctgttgctgaagggcaagccattgccatcacagaagtgaaagatccggtcttctcacaaaaaatgatgggcgacggttatgcagttgagcctagctcaggcaatgtttacgcaccagtttcaggtattgtaaccagtgtcttcccaaccaaacacgctgtcggtattttgtctgacaagggtgtagaagttttagttcacgttggtttagacacagttgcactaaacggtgctccattctcaactaaggtaacagatggtcaacgtgttgaagcaggggatttgctccttgtcgcagatttggaagccattcgctcagcaggacgtgaaacaactatcgtcgttgccttcacaaacacagctgaaatcaaatctgtcagccttgaaaatcttggacaggtcagtcaagatagccaagttgcgacagtagagttgtaaaaagtaaaaaagattgaaaagatgattgcagtcaactcttttcaatctttttcttttggatagtatgccatcagtatttttctaatttcttcgcttcttttttacctttttcagcgatatggaggaaataaatagaccaagcaaggaaaaataagggaataatgccacttctaaacaatgcgaatggggtttcaaagagaaaaccaaaccaaaaactggtaccagttcgttcccatagtcctggagttaggtaccaggatttaggattccaaagtgtgtatccattttggagtccaacttggtaatggataaaaaataaagtcagaaataatccgaaataggagtaggcataattttggtagcgtgaatagaatgcttttttcgattcggtatcagaaaaaatttctgtgcttgaagtttcgattgtttgttgaaaataatggatgccacatctacgactaccttgtataggttgccaaccacagtcttcaaatagagagaggtaatttgaatattctccttttgcaatatgttcatgaaaatcaaggcgtacgggatgaggggttcgactacatttttcaaaatgataggttgctgtccacggagttactttgacaagctgataaccttcggattgaatcgaattgatccaatgttcttcctcttgtaaactggtgaataatttgtgtcttatcatggcttcctccttaaaaacctaattctttggcaatatgatgtagtttttgaatacgctgtgtttccagtttaataatctcttggcccgttgctgttacttgatagacttttcttcttttatcggaacttggaacagaacaaatccattttagtttcaaaagattctcaatcgctccatacatggttcctgcagcgattttcacatcaccatcactcatatcctctactttttgcatgatatggtagccatgggcaggttccaagagggctaatagaatatagtaggttgtctccgttaaggggagatgcttgttccttttcatttggtttctcctatgtagttcaaatgtatagttgtattatatattatatatcggggaactatacatgtcaactgtatagtgaagaagattttaaaaatcttctcaatccttgccatttatggtataataaagcgattttataaaatgtaggaggttccccatgggacgtaaatgggccaatattgtagccaagaaaaccgcaaaagacggtgctaactcaaaagtttacgccaaatttggtgttgaaatctatgtagcagcgaaaaagggtgacccagatccagaaacaaactcagcgctgaaatttgttatcgaccgtgctaagcaagcgcaggttccaaaacacatcattgacaaggccattgacaaggcaaaaggaaacacagacgaaaccttcgtggaaggtcgttacgaaggctttggaccaaatggttctatgattatcgttgatactttgacatcaaacgtaaaccgtacggcagctaacgtgcgttctgcttttggtaaaaacggcggtaacatgggtgcatctggttctgtatcattcatgtttgataaaaaaggtgtggttgtctttgctggtgatgatgcagatgcgatcttcgaattgctccttgaagcagatgtcgaagtggatgacgtagaagcagaagacggcacaatcactgtctatacagctccaactgatttgcacaaggcaatcgtggcacttaaagaatcaggaatccaagagttcaacgtcactgaacttgaaatgatcccacaatcagaagtatcacttgaaggcgatgacctcgcaacatttgaaaaactctacgatgccctagaagacgacgaagacgtccaaaaaatctacacaaatgtagatgggttttaatataaaaaaagtgctagtagcactttttttatattaaaaggttggagattggaatcgtcggtagacgattctcattgtacgtgggacgtcctagaaggttggagattggaactgccgttaggcagttttctttgtatccaattgctcaaagacgatagttggttggaactagagaagtggggatattttagcttaagtttgaataaggtacgatggaaaaatttgcggagttttcggtggctgatagtagagtgcttgatagatgaggtataaggaaaaactatagccaggctttggaaatatctatttgaatggtcacgggttttctgttatcatagaacggtaataagattaggagaatgtatgtcaaataatttacttgttttacaatcagattttggtttagttgatggtgcagtttcagcgatgattggtgttgctctccaagaatcgagagatttagttgttcaccatctaactcatgatattactccgtacaatatctttgagggttcatatcgcctctttcaaacggtcgaatactggccggagggaacaacatttgtttcggttgtcgatccgggagttggttcaaaacgtaagagtgtagtagctttgaccgaacaaaatcactacattgtaacgccagataatgggacgctatccttcatcaaaaaatatgtggggataaaggcggttcgagaaatttcagaggtggccaatcgccgtgccaatacagaacattcgtacaccttccatggtcgagatgtttatgcctatacgggagctaaattggcttctggacacattagctttgaagaagttggtccagaattaagcgtggataagattgtggaaattccaacagtcccaacggaagttggttcggactatgtaaaaggtgcaattgatattctggatgttcgatttggctcgctttggacctcgattacgagggaagaattttacaccttgcaaccgcagtttgaagatcgctttgaagtgaccatatacaataacgacatgcttgtgtatcaaaaccaagtaacctatggcaagtcctttgcggatgtacgtatcggacagccattgatttatatcaattccctctatcgtgtaggtgttgcgattaatcagggctcatttgccaaggcttataatgtcggtgtaggtcaaaactggcatattgaaatcaaacgtattagtaattaaagaaattttaggagatagttatgaaaaataattcaatcaaaacagtcgttgctactggtatcggcgcagccctctttgtggttattggtcatttaatcaatattccaacctttgtcccaaatacttctatccagcttcaatacgctgttcaatcgctattggcagttgtatttggtcctgtggttggcttcttggtcggtttcattgggcacacgcttaaggattcgttgacttacggtccatggtggtcatggattttggcatcaggggtctttggtttggttgttggtcttaccaaaaaacgtctgcgtattcaagaagggatttttgaagggaaggatattcttttctttaaccttgttcagattgcggcgaatgtgcttgcttggggagtcattgccccagttttagatattcttatctatagtgaggcggcgaataaggtctttgcacagggacttgtagcaggtattgcaaacagtattacaattgctattgcagggacactccttttggttgtttatgcaaaatctcaaacgaagacaggtagtttgtctaaagattaagtttttattttccctagaaaaaattctagggttttttcaataccaaaaaatacatatatgatataataatataaaacaaacaaaaacatgtgttcaaggggagaagtatggtctggacagaagaaaagttgggaccgattattcattctatactcaatcctgacgaggaagttttaagtctttatcaatcgaaaacgacgaaatcaatttatggatgtattctttggaataattattattataaggtttttcgagttagtaaccacccatcacaatctacatataaacagccgactttttatgatttccatggcgaattttatatgaaaggagcgattcggacctacctttatcacacgaacagttggtatgaacttagtaaacaaggctattaccttcttctcttttttcaaaagttatgggatgaaaagcaagaggtggaggcgagttggcaaaatggtaggatgcagattcgcttagtggttgaagaagaggggtggcaagttcattaccgttttccagataatcaggcaagggaggttgaacgcttattgggctcaggcatgctggtggccattcgctcctccagaaattttatcaagatacggacgagtcgttttgttgcaccgtatatagctctaatcaaacagcgtcaactttatcgaaaaaagccgagtaaagctatgctccagtgggaaaaataccaaagtcaacttattgaaatccaaaggacctatcggctagtggaggaaagtgctccgcaaactttttttggacactggttgaataaggtccaactctatctctgctctgccattgccagctattgggaagaagttattaaaggagtggagtggcaggaggcaagagaaatcaaagagcaaaggaaagccgagaagccacataatcctattgaagataaatggaaggaaaatattgctagacgccataagcgaaaaatggaccaacttatcggacatgataccttggaaaaactccgacaactgaaaacagaattagacgactaagaagttatagcgaaccttcaataaatgcagtagcatgtcattcatgttaccgtatttttttacatataagcactgaacctgcgaatacaggttctaaattttcagttcagatttttgtcttttgaggggctaaacgatataatacgtaaggtatcatttattagaaatgacagagttttatcatctattgcaaagattgaaaaggagacactatgtcaaaagatattcgcgttctactctattacaagtatgttccaattgaaaatgccaaagaatatgctgctgagcatctagctttctgtaagtctatcggactaaaaggacgtattttgattgctgatgagggaatcaacggtactgtttctggtgactatgaaacaactcaaaagtacatggactacgttcatgcaaacccattgttcagcgatttgtggtttaagattgatgaagaaaatgagcaagctttcaagaaaatgtttgttcgttataaaaaagaaattgttcaccttggtttagaagacaacgactttgacaacgatattgacccactcgtgacaacaggtgcctacctatcaccaaaagagttcaaagaagctctcttggacgaagatacagttgttttggatacacgcaatgactatgagtatgaccttggtcacttccgtggtgcgatccgtccagacatccgcaacttccgtgagttgccacaatgggtccgtgataacaaagagaaattcatggacaagcgcgtagttgtttattgtactggtggtgttcgctgtgaaaaattctcaggctggatggttcgtgaaggctacaaggatgtcggtcagctccacggtggtatcgcaacctatggtaaagacccagaagttcgtggtgaattgtgggatgggaagatgtatgtctttgacgagcgtatcgcggtcgatgttaaccatgttaacccagttgtcgttggtaaggactggttcgatggcacaccatgtgagcgctatgtcaactgtggcaatccattctgtaaccgtcgtattttgacatcagaagagaatgagcacaagtatgttcgtggctgttcagctgaatgccgtgctcatgagcgcaaccgttacatctctgaaaacggcttgactcgtcaagaatgggcagaacgcttggaagcgattggggaaactcttactccagcaaatgcttagtaataccaaaattgcattgaaaaatcagtgcaatttttttgtgcaatcagaattctttatattttttcagtccattctatacgaagcctatcaattagaaaagagaaggagatgaagtcattttggatgaacttatccccttcgaaaatcaacattatccgttgtcaacttgccttgatgaacttcagttctatcttcggcttcgtttcctcggtcacttttgattttcattgagtattagcagtagcagaccttgaatagctggtcggttttatgaagcaatcggttttgcagttgcgacgtttggagatattaagtctgcgactttgcctaagggtggcaacttgattttgatgcaggcagatagctttgctcaacgcgtaccatttcaggtagtagcgagtggcaatgaagtcttgatttcgcttaatgtggcgagtagggaagaagtagatagaattatcgagcgtgttgaagcaaatggcgggcaaattacaggatgcccgacagatgcccgtggcttttatggagcaagttttacggaccttgatggtatcattttaatgtgattgtgatgtaggaagttagaattcatctgctctagaatcatagatgaacttatttgaaaagggagaaactgatgattcttcctttttttcagagtcaatttacgctataatagtcctatgaaaaaaatcattgagtttaaagattttacatttaaataccaagcgcaacaggaacccactttaaaagatattcagttaacgatttatcagggagagaaagttctgattattggcccatctggttcaggaaagtcgacgattggacaatgtcttaatggtattattcccaatatttacaagggagaacatagcggaagtttactattggatggtcaggaagcatttaatctttcagtttatgataagtccttgctcgtatcaacggttctccaagatacagatggtcaattcattggcttatcagttgccgaggacctagcttttgctttggaaaacgacatggaaagccaggtggtgatgaagcaaaaagtaggagattgggcagaaagactgtctttgaccgatttgctggcacatcgaccacaagatttatctggaggtcaaaagcaacgtgtcagtctgggcggagttcttattgatgagagtcctattttgttgtttgatgagccacttgctaatttagaccccaaatcgggccaagatacgattgatttgattgaccgtctgcacaagcaagaagggaccacaaccattattatcgaacaccgtttagaggacgtactgtatcgtcaggtggaccgagttgtattgattaatgatggtcggattttgttcaatggaggaccggatgatttattacgtacctcattgttacaggaaaacggcatccgtgaacccttatatctatcgactcttcgcgccttaggatatccgattgcgcaggcagaacgcctctcttcagtttgggaaattgatattgaggctttgaatatagcatccctaccgactctacactttgaaaatggagagaaagaggctttgttagaagtcaagcatctttatttttcctatcctaacaaacaagttcttacagacattcaactgacgattcataagggggaacgtctagctattgttggaaaaaatggtgctgggaaatctactttagcaaaggtgctttgtggttttattcagggtgagggtgagattctctggaaggggcagtcaatcaaagaagattctgtcaaagagcgagcagaacggattggttatgttcttcagaatcccaaccaaatgattagccaaacgatgatctttgatgaggttgctcttggtttgcgcatgcgaggggtgacagaagaagaaattgaacaccgagttcaccatatcttgaaagtatgtggcctgtatccgtttcgtaattggccgatttcggcactttcctatgggcagaaaaaacgggtaacgatagcatctatcttggttctcaatccagaaattattttgctagatgagccaacagcaggacaagatcaacgacattatcgggaaatgatggagtttttggatcaattaaatgctcaagggcacaccattgtcatgattacccatgacatgcaactcatgctagattattcagatagagctgttgttgtggtggatgggcagattattgaagatgccagtccagcagaaattttatctgatgatacggtgattgagcgagccaatttaaaagaaacatcaatttttcacttggcggagagggtgggagttaatcccttagaattaacgacgttttatatgcaggaagaaaggagaggaagatgagtcaacaaaaactaattggttaccatccaggaactggcttgattcatagtttatcggctgtcagtaaattactcttttttctcatagtttccattcttgctatgattacttacgatacccgcttgattctttttatcgcagtattttctctagccttgtttaaaatgtcagggattcgttataaagaaatctctcttgttttaattctgacaatcatttttgctgcaatgaatgccctgatggttcacttgtttgcaccacggtatggagtggaactttacggagcagacactcccttgctatcaggtctgggagtttattccttgacgagtcagcaagcattttatctggtgaatcttctcttgaagtatttttgtacagttcctttagcgattatctttctcatgaccactcatcctagccagtttgcttccagcttgaatcaaattggggtatcctacaaagttgcttacgccgtcagtttgaccatgcgttatattccagatattcaagaagagttttatacgattcgaatgtctcaagaagcgcgtggtttggaattgtctaagaaaggaaaattgatggatcgtataaaagggaatctatcccttgtcattcctctgattttcagctccttggagaggattgatacgatttcaacggctatggaattgcgacgttttggaaaaaataaaaaaagaacatggtatacccaacagcctctacagagaatagattacgctgtcttgctatttattcttgctctagtagtggtgacaatctatctattttttgttaatcaggggcgattctataatccgtggcgatgattattgagtttattggacttatcaaccctttatcgttgacatataggaaatatactgttacagtagggaatgtaaataaatttagagtttaagtatcagtttcatcttttgtttttcctcttgataagttttacaaataaataaaaagaggtaacacaaatggtacaaggtacagttaaatggtttaatgcagaaaagggatttggttttattgctcaagaaaacggtccagatgtatttgcacacttttctgaaattcagtctaatggtttcaaatcgttggaagatggtcaaaaagtgacatttgaagtggagcaaggccaacgtggtcttcaagcaaccaatattacaaaaattggataataaaagagcgggtttcttagtgaaactcgctcttcttatgtttaaaggggtcttttatttggcataccagctttgcgtggaaacttatttggagtttcctttttcttttcgacgatggtcaatgttcgagggtcgccatttggaagagtatagtcgtggttttcgatgacttttgcgaagaggagattgagtgcgttttttgcttgggtcaattcatcttctgcgctggacgccttaagtgcgattaattttccgtggagcttcaaataaggaatagtcaattcagaaagaatctgcatgcgggcaactgcgcgtgctgtgacaaggtcaaattgtgcacggaagttcttatcttgtgcaaagtcttctgcacgaccatgatagaaatgaacaccttcaagctctagttcttcggcaagcaaatgtaaaaagttaattcgtttattaagagaatcaatgatggtaacatctagttgcggaaagatgatcttcataggtaggctaggaaatccagctccagctccaatatctaaaagccgaagaggttcgttctgaatatggccttgcaggagtggagcgatagaatcgtagaaatgcttcagatagacttcgctttcctcggtaatagctgtcagattgattttttcattccattccactaatagttggaaatagcgatgaaattggtgtttttgttggtcagttaattgaataccttggtctgccaaggttttataaaatacttcaggtttcataatcttatcttatcataatttaagcaaaagaaaaacccagaagagtctgggaattttcttattgaccatctgtctgtcccgttgcgggattgtttcctgttgttgcagtttcagttgaagaagttgcagtctcggttgcagttccagatgatgtttcgcttgatgttgtcgtcgcttcggttgtttcactagtttcagtcgaactagaagaacttgtactagagctagtgtaagtattataagcattggagagtgagcgactacctctgagatagtagttggaaccgtaacgtacgagtccgcttggcatctcccaatcggtagctgtatagtccgaatgcataaagagcatcatattgtggtagacatctgttgcaattcgcatgctgttatcaaggataggagtcatacgattggtatatccggtccaaacagccattgcgtactgactagaatatccaacgaagttttcatcaggaacgaccatgtagctataatttgcttctggaattgaagctagaatagtatccgtttcgctatcggtatagtttgatgtacctgttttaccggccataggaacaccactaacagaagcgtttaatccataaccgtaagacataacagccttcatcatgtcggtcatcatgtaggctgtttcggcagacatgactttggtccctttaggagcatattctgttactgttccatcactaaagacaattttattgacatactgtggagcgtagtaagtaccaccattggcaaaagcagcgtaggcagcagccattttttcactacttgctccatacttactgctagtatcggatgtattacttgaaatagcattagagtaatgaatatctggataattgataccaacgctattcaaaaatttcaaggcattttctaagcccgtagcttccaatgctttaacggcggtaacatttcgagaatactgaatggcagtcttaacagagatattaccgtagtattgtttatcccagttattgacaggagttggtgtaccaggatagttataaggaccgtctaagattaaatctgctgtagatgtataaatgccgttttcaaaagcaggagcatagtctgtgattggcttcattgtagaaccgaagtcacggttggtttcaacggcttggttggtaccaaatgagacgtttgtttcttgtttacgaccccctaattgcgcaacgactttaccattagaaacatccacaaccgttgaagctacctgcaataaatcatctggatagctgacatacatatctgtattgtagatattccaaagttgctgctgggcggcaggatcgacgttcgtatagacatccatccctgttgtcagcaagttgtaacctgtttttgcttcaacttcttcaacgacttgtttcagatagttgtccatataagcaggataagcagctgcattagatagtggttgcaaaccatctgttacaggtgttagaacagcttgttcatactgggtattatcaatgtacttttcttccagcatctcagccaataccaaatcgcgacgtgcttttgcatcttctggattggtataaggatcatattggtttggcgcttggggcattcctgctaaaagagctaattgaggaagagtcaaatcttttaactcttttccataaaaagcaagagcagcagtcttcataccgtaattaccgtttgacatatacaccttgttgatgtagtaggtcaaaatctcttgtttggtattgcgacgttccaattgagtagctagccaagcctcttgaattttccgttttagattttgatcttctacggatgtcgagaaataagtcagcttgataaactgctggtcaagtgtcgagccaccctgcaaacgtcctccgctcaagttattaatcagggaacctgcaatacgaatcacgtcaactcctctatgattgaagaaacgttggtcttcgattgcgacaatcgcatttaccaagtctgttggaatttcttcagtcttggcactcgaacgtttttctgctcctaaatctgcaataagatttccgttcttatcataaattttacttgacacagttgctgtcaaagattcttctgtcaattctggagcgctttggatgtagtaaacaaccaatgcagctccggccaggcaggcaatgatagcccccgcaagtaaaatatttgcagtgattagaagagcttttttaattgttgtagttttcaaaagattcaccacctaatagatttttttcaacgatttccagatatgggatgctggggaaacgccccatttgaatctcaaagccgtattgtcgaataaaggttagaggcatcgacttactacccatgtctacttgataaaattcgatcaaatgagtggctggcaagagataggtttcttttaatgttgaaaagtgaagaaggacaaaacaaataccaccttgtttaacaacctgtttcatgtgttcaatctgatgcgcatgaaaatttttcatgggcatggatgctttttggcgtgtctctttcgcttcaaaatcaatataatgtcttttaaaaacaccagagtagtctgtggtagatgcctgtcgaaagtatgcttcgacaatcttagcacggctccgtttggggtaatcaacttttacaatttgcacgggagttggcttcttgtgaatgacagcaatatcgtgcgcaaggtaatattgattgctatcgttgatagcggcctcaaaagacattccgcgattagcaaagtttactcgctgggatgaaataggactggttctattgattttttttgacaccttatgaggataattgaccatagaactccttcttgataaaataatatcagcatattataccataattagcgaaaagagtacaagaaatggatactaagagccttttggtaacaggttatagacatacagacctgggaattttttcagaaaaagatcctcgactgcacattattaaatctgcaattcgtaggaattttattcgttttttagaagagggtgttagttggtttatactgacaggtcaattgggttttgaatactggtccttagaagtcttagaagatttgcgagccgaggggtatcaactgagtattgcaacaatatttccatttgaaaatcatggcgaacagtggaatgaggctaaccaagcaaagttagcacggtttaagcaggttgattttgtaaagtatgcctatccacgctatgaaaacccagggcaatttagagactataaccagtttttactggataatacgacaggttgttatttgttttacgattctgaaaatgaaaccaatttgaaatatttatatcacatggtcttaaagaaagaaggatataatagaaaaacgcttacctttgaggaattgaatgaggaggctgaaaatttttcaaattctgagtgatttgacttgatttttccctattttttttaatataataggagtagtgacgttttagattagggagagagagatggcaagtattaaatttacgacaaaagatattttcgagcaagattttaaaattggttttcgtggctatgatcaagatgaagtgaacgattttcttgatgatattatgaaagactatgatgcttatgaagcgattatcaaggaattaaaaggcgaaattgctcgattgaaagcgcaggcagcaaattctcccaaaacaactcttcctactgaagaatcgaacgatgtattgcgtacagaacgtccatcttcagcgacaaactttgatattctccgccgtctgaatcgtctggagaaagaagtatttggaaaacaaatcgttcaggatcaagaatagaaaattgtacacctaaactgacactttattcgcagttattttcttgtgcacaaatacattctgtatttgtgtcagagatattccttgatttaaagtggcttgctttgtagatacaacttctaagataattaaggtgcaatttttggataatcgcgtggtagttttctaccatgaggaaagtccatgctagcactggctgagatgccagtagtgtttgtgctaggcgaatcaataagcctagggacgcccttgggcgttacggcggttaaaatggctaagtcttttgatatgtcagagtagatctgaaagtgccacagtgacgaagtttttatggaaacgtaaaaaatggaacgcggtaaacccctcaagctagcaacccaaactttggtcggggcatgggatggatggaaatgaacagaaatcctgactgtttagacagtagacagatgattatcgaaggtggtagaacctagtaccactggaacaaaacatggcttacagaaaattgcataaaataggtagctagctctgctagcttttattgtagaggaaaaaaatgaaaaaacaatttgagttgattgcaacggcagcagctggtctggaagcggttgtgggtcgagaaattcgtaatctcggctatgaatgccaagtggaaaatggccgtgttagattccaaggagatgtaaaatccattatcgaaaccaatatctggctgcgttcagcagatagaattaaaatcattgttggacaatttccagcaaagacttttgaagagttgttccaaggagtttttaacttggattgggaaaattacttgcctctaggctgcaagttccccatttccaaggccaaatgtgtcaaatcgaaattgcataatgaaccaagtgtgcaggctatttctaagaaagcagttgtaaagaaactgcagaaacacttctctcgtcccgaaggggttcccttgcaagagatgggggcagagtttaaaattgaagtgtcgattttgaaagatgtggcgacagtcatgattgatacgacaggttctagtttgttcaaacgtggttatcgggtggaaaaaggtggcgcaccaatcaaagaaaatatggcagctgctattttgcaattatcgaattggtatccagataaaccgcttattgaccctacttgcggatcgggaactttctgtattgaggcagctatgttggctaaaaatatagccccaggtttgaagagaagttttgcatttgaggaatggccgtgggttgaggatcaattggtggttgcattacgcaaagaagcacaagcttctatcaaaacagatttggtattagatattactggatcagatattgatgctcgtatgattgaaattgcgaagaagaatgcatttgcggcaggagttgagcaggatattgttttcaagcaaatgcgtgtgcaagacttgcgtacagataaaattaatggtgtcattatttctaatccaccttacggagaacgtttgttggatgatgaagccattgttaccctgtatcgagaaatgggggagacttttgaaccactcaaaacatggtctaagtttattctaactagtgatgagttgtttgaaacccgttttggacagcaagcggataagaagcgcaaactgtataatgggaccctaaaagtggatctttatcaattttttggtcaacgagtgaaacgtcaagtgcaagaagtgcaaggataggaggacatcgtgggagaaaaaaatagtcatcatcttcctttggatgaggagaaagttttagattttgaagtggcgaaagatttaacaatcgaagaagcagtcaaaaaacataaggagattgaagcgggtgtgacagaagatgatggtctcttggatcgttacatcaagcaacaccgcgcagaaattgaatctcaaaaatttgaaaccaaaatcaatcatcttcctttagttgaggtggctgatgaggaaaaaaatcaaggacatgaaagcgcggaagaggtagaagcaaatgagtcttctcttacggaagttagtgaggagattgctcctattgtagaagaactttcggtaactccgatggaaaccttggaagaaacagtgattgcaagtaccgtagcaatggaggggttatcttcagtggcagatgattctagtttagaattggaagaagatgaaaccgaagacttggaccatagtgagggcgcagatagggatcagaaaaagaaattttacttctggtcagcagtagggctttcaatgattggtgtaatggcgacggcgctggtttggatgaattcggttaacaaatcgaatactgcgacttcttcaagttcaacaagtacaagccagacgtcatcaacagcatcaagttcgacagatgcgaatgtgacagcttttgaacagctctataatagtttctttacggatagtagtttgaccaagctaaaaaattcagagtttggtaaattagcagaactgaaagtgctgttggaaaaattggataagaattcggacagttataccaaagctaaagaacagtatgatcatcttgaaaaagccattgcagccattcaggccattaatggtcagtttgataaagaagtcgttgttaatggtgaaattgatacaacggcgacggttaaatcaggagaatctctttctgcgacaacgacagggattagtgcggttgacagtctattggcatcggtcgtgaattttggtcgttcacaacaggaagtcgcttcggctacggtagcaagtgaggctgcagttacaagaaaccaaggtgctgatgaaactgtatctactggtgtaccagcgacaacagaagtcgcttcaacaacggtttcaggctcaacaaccgactttggtattgccgtgccagctggtgtcgtcttgcaacgtgaccgcagtcgtgttccttataatcaagcgatgattgatgatgtaaacaatgaagcatggaatttcaatccaggtattcttgaaaatattgtgactatctcgcaacaacgtgggtatataacaggcaatcaatatatcttggaaaaagttaatattatcaacggcaatggctactacaatatgtttaaaccagatgggacctacttgttctctataaattgtaagacaggctactttgtcggtaatggtgctggtcattctgatgccttggattattaaacaaaaaagcggtttatctgcttcggattgaagaaaaagttcattttggacaatttccttcaatcttttttctttgtgttgaaaatatagtcatttgaattaactttgatacatcgtcactttcggcttgccgtactctgcagaagtgacttgctttgcaagttatatctccaacctagcacagccactaggctgtgctagcaacctgcacctcggttccttgtctgaaagctaattcattcgactataaaaaaactctcagaaacgccgaaatatcaatgtttctaagagtttaatgatttgctatctttcgcaaacttcttcaattttatatatttttaggagtttgtctacgttctgagcggtgtatccgctttttttgttagattggttttctttcaaaggcatctgtagagattccctgagaaaggattagtttggcccattctttagctgaatgaaggctgtggtctttgtagttaccacatgattcaatggttgtcccaggaacatcctcccaagtgatgccttctgcaatttcttccaaactcgacttgatgacttgagcaatcttttcagagtcttgttttccccacataatcatgtggaaacctgtccgacacccgaaaggagagcagtcgattagcccatcgatgcgctggcgaattagtttagctaatagatgctcgatggtatgtagaccagctgtatccattgcattttcgttgggttggataaggcgaatatcaaagtttgtaataatgtctccttttggtccgacttcttcagaaattaagcggatgtaaggtgcttttacaatagtgtggtctagctcgaagctttcgacagtgacttcttttttcatggtttcctccaaataagtgatgaatttattataccatatttgacaatttggaattgtgaaatcgtttcaaatatgataaaatagatacagattttgtgaaaatcgaattataaaaaaagaggtagaaatatgaatatcattacagtagtagtgacacttgtttctgctctcattggtttagtattaggttactttgccatttctttgaagatgaaatctgcaaaagaaactgcagaattgacacttttaaacgcagaacaagaagctagtaatgttcgtggtcgagcagaagagcaagctgaggttattctaaaaacagctgagcgcgatcgccagaccttgaaaaaagaattactcttggaagctaaggaagaagctcgtaagtaccgagaagaaattgcagaagaatttaagtcagaacgtcaagagttgaagcaaatcgaatcacgcttgacagagcgtgcgaccagtttggaccgcaaagacgataatttgaccaacaaggaaaagactttggaacaaaaggaacaaagtctgaccgataaagctaagcacattgatgagcgtgaacaagaagttgtaaaactcgaagaacaaaaagctttggagttagaacgagtggcggccctcagtcaagaagaggcgaaggaaatcatccttaccgatacacgtgataaactgacgcatgaaattgcgactcgtatcaaggaagcagagcgtgaagtaaaagaacgttctgacaaaatggcaaaggacttgttagcccaagcgatgcaacgcatatcaggtgaatatgtggctgagcagacgattacatcggttcatttaccggatgatgcgatgaagggacggattattggacgtgagggtcgaaatattcgtacctttgaaagtctcacaggtatcgatgttatcattgatgatacaccagaagtggttgttctatcaggttttgatccgattcgccgtgagattgcccgtatgaccatggagaccttgcttcaagatggtcgtattcatccagctcgtattgaggagttggttgagaaacatcgtgtagagatggataaccgtattcgtgagtacggggaagctgctgcttatgaagttggggcaccaaaccttcatccagacttgattaaaatcatggggcgtttgcatttccgtacctcttatggacaaaatgttcttcgccactcaatcgaagttgctaaattagcaggtgtacttgctgctgaattgggcgagaatgtgaatttggcacgtcgagctggtttcctacatgacgttggtaaagctattgaccgtgaggtggatggaagccacgttgaaatcggtacagaattagctaagaaatataaagagaatccaattgttatcaatgcgattgctagtcaccatggcgatgtagaagcaacaagtactattgcagtcattgtggctgcggcagatgctctgagcgctgctcgtccaggttcacgtcgtgaatctatggaagcctacatcaaacgtctgcaagacttggaagaaatcgccaacagttttgaagggattaaacaatcctatgctattcaggctggtcgtgaaattcggattatcgttcatcctaacaaggtcactgatgatcagattaccatcttggcccatgatgttcgtgagaaaattgaaaataatctggattatccaggaaatatcaaaatcacagttatccgtgaaacaagagcaacagatgttgctaagtaaatgtagaagagtccgaagggctctttttctactggctcaaagttcgttttgggttgggaatagaaaatagaaaatattttaatcgtatttaaaagcagttgaaattcatgctaaattttgttacactagaatgaaagatttaaaaggagatatcatgaaagagcgaggcttactcattgtcttttctggtccatctggtgttggaaaaggaacagttcgaaaggaaatttttgaaagctctgataataaatttgaatattctgtatccatgacgacacgtccacagagaccgggagaagttgatggagttgactatttcttccgtagtcgtgaggaatttgaagatttgattcgccagggtcaaatgttggaatatgcagagtacgttggaaattactatggaacacctctgacctatgtcaatgaaactcttgataagggaattgatgtctttttagaaattgaagtacagggtgccctccaagtgaagaaaaaggttccagatggggtgttcattttcttgacaccacctgacttggaggagttgcaagatcgcttgattggtcgcggaacggatagtgaggaagttattgctcaacgtatcgaacgtgccaaggaagagattgccttgatgcgtgagtatgattatgcagttgtgaacgatgaagttccgttggctgctgagcgtgtcaagcgtataatcgaagcagaacatttccgtgtagaccgagtgattggtcgctacgatgaaatgattcgtgaacagatagtagaacgataaaagaaagaagagagaatcgcattatgatgttgaagccgtcaattgataccttgttggataaggtaccatctaagtattctttggttattcttgaggctaagcgtgcccatgaattggaagcaggtgccaaaccaactcaagaattcacctcagtgaaatccaccctacgcgccttggaagaaattgaatcaggtaatgtagtcatccatccagacccagaagcgaaacgtgaggctgttcgtcgccgtgccgaagaggctaaacgtttggcggaagaagaagagcgtaaaatcaaagctcaaattgctaaagaaaaagaagaaggcgaaaagatttagatacaagactcggttgggattgccatccgggtttcttttcactttcggaatgatgaaagttttgacagaaaggaggcaggtcatttagtttatcttttaatatttgctccaactaatagttgaaggttatacataaagtgaaccttgttcgcatcagtcgtgatattagaaggtaaaataaatcgagatggtatgttagcacagattattgtagacgtccctttgatgcagacagatcaagcttattcctatcgagttccagctgagttggaagaggggctcaaggttggcgtgcgtgtccatgtaccctttggtaagggaaatcggctgattcaagggattgtagttgatttgattgatgaagatgatgaaaatagcttacaagacttgaaagagcttgccgaggttttggactatagtcctgttctcaatcaagagcaattttggttggcggaccagatgagaaagtcggtcttctcctataaaattactctcttaaaatccatgctacccagcttgctcaattcgacctatgacaaattgatccgtccagggattggtttggaaatggcagagcagattagtctgtttggtgataaggagcagattcgtttttctgacttggacgtgacagagcaagggaaaatcatgcgtctggcccagtcaggaaaaatcttggtagactatgtggccaaggataagaagcaaatcaagacagaaaaatggtaccgagtttgtctggagaaattacgagaagcagacatcagcaatcgggctaaaaaacggcagcagttaagggaatttcttctggaacagtcggaagaccagctcctttcaaacctaaaatcggactattcagctgatacgctccgctatttccaagaaaaaggctatatagaagtctgggaagaggaagtgtcgcggactcagggtgtttttgataaggtagaaaaaacgcaggccttggatttgaatccagagcaggccattgcggttcgggagattgtagcctctatcggtcaggaaagtcagacatttctactgcaaggagtgacaggttctgggaagacggaagtctatctccaggttattgatagggtcttgaagatggggaaaacggctattatgctggtgcctgaaatttccttgacccctcagatgaccaatcgttttatttctcgttttggtcagcaggtcgcgattcttcactccggtctgtctgatggagagaagtatgatgagtggcggaagattgaggcggggaatgcccaggtggttgtcggggcccgttcggccatttttgcccctttgacaaacttgggtgttatcatcattgatgaggagcatgaagcgacctacaagcaggacagcaatccacgctaccatgcgcgtgatgtggcaaagttgcgggcagactataatcgagcgaccctggtcttggggtctgctacgccgagtcttgaaacacgggctcgggctagtcgaggagtctatggaagactgactcttaaccagagggccaatcccttggctcgtattccagaagtggaagttgtggatttccgtgattatatcggtcagcaggaggctagtaattttacccctgttctgattgaaaagataagagaaaaattggctcgtaaggaacaggtcgttcttatgttgaataggcgtggttattcttcttttgtcatgtgtcgtgattgtgggagtgttgaccagtgtcccaattgtgatatttccctaacgcttcacatggatacaaaaacgatgaattgccattattgtggttttcaaaaggggattcctcagacctgtccaaactgtcaaagtcgttctattcgttattatgggacgggtacgcaaaaggcctacgatgaattgcaggagctcttgccagaagctagaattttgcgtatggatgtggatactaccaagaaaaaaggtgctcatgaggacttgctcgaacggtttggtcgaggcgaagcggatattcttctgggaactcagatgattgccaagggcttggattttccaaatgtgaccctagttggggtgctcaatgcggatacggctctgaatttgcctgattttcggtcttctgagcggaccttccagttgctaactcaggtagctggtcgggctggtcgagctgataaggaaggagaggtcctgatccagacctataaccccaatcattatgccattgcttttgccaaagagcaggactatgaaggtttctatcgttatgagatggacattcggaaaaatcttggctatccaccttactattttacggtgggtctaaccttttcgcacaagtcagaagaatttgtcgtgaaaaaagcctatgaaactgtagcctttctccgtcaacacttaacagatgcaattcaaatcttgggaccgacgcccaagcctattgccagaactcataatctctaccactaccagatcatcttgaaataccggcatgaagaccgtttggaagaggtattgaatcagattttggattggacacaggagagagaaaatcaagatttgcgactgattattgacaatgaaccgcagaatatgatgtgaggtcactattgaccttgcatttttttgttttaagaacctttgattaaggaaaaaataagcaaaaatgatataattaggggatagtataattgatatgaatcagaaaatgaaaaggagatgagaacacgaatatgacaaagttgatttttatgggaacgccagcgttttcagcgacggtcttaagagggctcttagctgatgggaattataacatactggcagttgtaacccagccagaccgagctgttggacgaaaaaaagtcatccaaatgacacctgtgaaagaagtagccttggaatacaatttaccagtctatcaaccagagaagctatctggaagtcaagaaatggatgagctgatgaatttaggagcagatgggattgtgacggcagcttttgggcaattcctaccaaccaaattattgaactcagttgactttgcggtcaatgttcatgcttctcttcttcctaaataccgtggcggtgcccctatccattacgctttgattaacggtgatgaacgtgccggtgtaaccatcatggaaatggtcaaggaaatggatgccggtgacatgatttccagcgatagcattgctattgaagaaagcgacaatgtcggcaccttgtttgaaaagttggctgttgttggtcgagatttattattacaaaccttaccagcctatattgctggtgacttgaaaccagtcgctcaaaatccagaacaggtaaccttctcaccaaatatccagccagaagaagaggtactggattggaataagacagctcgtcaactatttaatcagattcgcggtatgtacccgtggcccgttgcccacacctattggcaaggcgaacggtttaaaattcaagaagctgtagaagcagaaggtgaaggatcagttggtcgggttattgctcgaagcaagaaagaattgatcattgcgacaggtcagggagccctttctctgaaaactgtccagccagctggtaagccaaaaatgaccattgcagactttttaaatggtgcaggtcgagatattgcagtaggagatcaatttggtgatcaataaacatgaaacagcaagaagtctagccttatctgtattggaacaagtctttgatcaaggtgcttactcgaacatcgctctcaataaggctctagaatcttctcgtttatcagcacaggacaagggcttggcgaccgaattggtttatgggacggtttctcgtaaaattaccctagagtggtatttggcacattttatcgaagatagggaaaagttggacacttgggtctactatctcctcatgttgagcctctaccagttggtatatttggacaaattgcctacccacgcagttgtcaatgaggcagttaatattgccaagcgaaagcctggaactgacaaatttgttaatgccattttgcgtaagcttagtcaggattccttgccgaaaccagcagatattaaaagaaagaacaaacgtctatccgttcagtattctgtgccagtttggttggtccaaaccctgattgcagaatatggcgatgaacgtgcagagaagattttccaaagtttacatgatcggaataaggccagtgtacgtgtgacagatggtcaacaagtggagcgattggcagaggagctaggcgctcaacactcgcagttatcaccagttgggttggttaagcctcatggacactttgcggggacagattatttcaaggaaggactcatcactattcaagatgaaaccagtcaattggtagctccgactttggatattcaaggagatgaaatcatcttggatgcctgtgcggctccgggtggaaagacctgtcatatggcaagctatcttacggatggaaaagtttatgcgttggatttatatgatcataaactaaacctgattgaagaaaacgcacgtcgtttaggcctagcagataagattgagaccaaaggtctggacgccagtcgtgttcatgaggaatttggtccagatacctttgataaaatcctagtggatgccccttgttcaggtattggactcatccgccgtaagccagatattcgttataataaggcatcgatggattttgattctctaaagactatccagttgcagatactggacagtgtttgccaaagcttgaaaattggtggtataataacctatagcacatgtacgattattgctaaggaaaaccaagaggttattcaagaatttctgcaaaaccatcccaattttgaacaggtgacactagaacaccctcaaacagatattatggtggatggttgcttgttgataacccctgaacagtataagacagatggctttttcatcggtcaacttagacgaaaatcctagaataagaggaggaagttgcttagcaacgataaaaattatggaaattgcattacttactgatgtaggacagaaacgttcgaacaaccaagactatatcaatcgctacaaaaaccgcgcagggattgatttggtcgtgttagctgatggaatgggtggtcaccgtgccggccatattgctagtgagatggcagcaacagatttgggagctgcttgggttgatactcaattagtgactttgaatgatgtccgtgaatggatggttgcaatcattgatgctgaaaaccaaaagattcatgaacttggacagacagaagaatacaaggggatgggaacaactcttgaggcagttgttgtcatcgacaatcaaatgatctatgcccatgttggagattcacgagttggattgattagagatggcgaatatacacgtctaactaacgaccattcgctggtaggtgcccttgttcgagctggtcagctcacagaagaagaagcacagcgtcatcctcaaaaaaatattgtaacgcagtccattggacaagccgaaccaattgaaccagacattgctttgaaaactcttgaggttggagattatgtccttattaacagcgatggcttaaccaatatgataccaaccgaggacattcgtgatattgtattgagtgatgtttcaattgaaagcaaggtagaaacacttgtacgttttgccaataatgcaggcggtctagataatattacagtaggtttgcttcacattacggaggaggctaggtaatgattcaaatcggtaagatctttgccggtcggtatcgaatcgttcggcaaattggtcgaggcggtatggcagatgtttacctagcaagagatttgattttagatggagaagaggttgctgttaaagttcttcggaccaactatcagacagatcaaattgctatccagcgttttcaacgtgaagcgcgtgccatggcagaacttgaccatcccaatatcgttcgtatttcggacatcggtgaagaagatggtcaacagtatctggctatggaatatgtcaatggcctcgatttaaaacgttatataaaagaaaatgcaccactttccaacgatgttgcggtgcgaattatgggacagattctccttgctatgcgcatggcgcacacgagaggaattgtccatcgagatttgaaacctcagaacgtccttttgacttccaatggagtcgctaaagtaacagactttggtattgcagttgcctttgctgaaacgagtttgacacaaaccaactccatgttgggttctgttcactatctttcacctgagcaggcgcgtggttcgaaagcgaccattcaaagtgatatttatgcgatgggaatcatcctttttgaaatgttgacgggtcgcattccctatgatggagacagtgctgtgacgatcgctcttcagcatttccaaaaacctctcccatctgttagagaagagaatgccaacgtacctcaggccttagaaaatgttgtactaaaagcaacggcaaaaaaattaaacgagcgctataagtcggttgcagaaatgtatgcagatttagcttcggctctatccatggatcgtcagaatgaacccagggttgaactagaagggaacaaggttgatacaaaaaccttgccgaaactctcccaagccaatgttgaaacgaaagtaccgcatacaaacagttctgctcaagtttctgcgacggataaggggtctggtaagaaagaagtggcgaagtcgggaaataagcctgtttcaaaaccaaggccaggcatacgtacacgctacaaagtcttgataggagctattttgttaacagtcatagcggctggactcatgtttttcaacactccacgaacagttacagtccctgatgtatctggtcaaaccgttgaaaaagctacagaaatgattgaagtggcaggattggaagttggaaatatcacagaagaagcgacagcgactgtagatgaaggcttggtaatacggacctctccggctgcaaagacgaccagacgtcaagggagtaagattgatattgtagtagcaacggctgcgctggcatctattccagatgtggtggataaggagtctgatactgcgcggcaggaattggaggcccttggtttccaagtgacaataaaagaagaatatagcgaaaaagttgcccaaggactcgttatcaaaacagatccaggagcaaatagttctgctgagaagggtgcaaaaattaccctttacgtttccaaaggagtggcgccacaagttgttccaaacgttgttggaaaaagtcaggagaatgctactcaaattcttcagacagcaggcttcagcattggaaccattactcaggaatatagctcatctgttactgcaggtcaggttatcagcacagatcccgttgccaatacagagttggcaaaaggttctatcatcaatctagttatttcaaaaggaaaagaattgattatgcctgatttaacatctggcaattacacctattcacaggcgcgtagtcaattacaagccttgggtgtcaatgcggaaagtattgaaaaacaagaagatagaagctattattcaacgacaagtgacatcgtcattggacaatatcctgctgctggagcaacaattgatggaacagttaccttgtatgtctctgttgcatcaaccagaaccagtagcgattcttcagcaggaagttccacaagtacaagtacttcaacaggtagcggacaataaagatgaataaggttggggagatacccaatgtcattaagttatctaacctatcacattttgtgatgggttagtttttttatgttacactaaaaataaaaggggaaaagtcatgctagatcaaattaaagctcatttatactcttcgaaaatcaaaattatccgttgtcaacttgccttgatgaactccagttctatcttcgacttcgtttcctaggctacttttgattttcattgagtattacttgatagtatagacaatatttagttttatagccctttagtttctctttgattacttcatcaacttgctttgaactaaaagtaaactaaaactatatatcagtcagtcctatatttcctactttggatggagttcttttacttattttttgttacaatagtatagaaaggatggagaagatgcggaaagttcaattttttctactaatagaaagtatgatttttacgatggcagcctttgatgtggtagccaatgaggccagtcggaccctgctacttttctctgccttattactcgtcatttggtacttcctaggaagaaaagtcaacagtgttttactggtcagctccttatctctattatttttggtctttgttttaaatcccttcttcattattgggattatgctactagtcgtgtacatgctgattaatttcttttcacgttatgaaaagagaaatcaatatacccacattgtttttagtgactattctctacaggttcaaaaagagaaaaatagatggtttggcaaccacgaccactctcaagataggtttggttttgaagatattaacattgtacgcttgtttggcaatgatgtagttgatttggataagactgtattagttggcagagataatattgttgtaattcgtaaaacgtttggacggacaaaaattattgttccaattgatgttgaggttgcactttcagcaactagtatctatggacgagtaagtttcctgggtgaatcatattgggatttgcggaatgaaagtatagcggtcaatagtcccgattatcaagaatcacacaaacgtgtaaaagtcgttaccaacaatatactgggagatgtggaggtggttcgcgtatgagaaaacgtacctacctactcctcgcctggtttgcctgtcttattgtttttgtggtgattgcttccaccctcccacttttaaattattcattgctagatgttacgctctggatttcaacggagcagctcgtgtttactctcattctactagttattgttttgaccctttttctagctgtaatggtacaaactgtcagcctagcctccactcaggttatgcggacgaagttacaagctatcttgaagaataaaagtattcgaacagataccgaaagtgatcagctcttgctccagttgtctgataaggtcagaaacctcacgcgtcaggtgcagctggttgacaatcaagatttagtcaagaaagaagagattgttgagggagaacggaaacggattgccagggatttgcatgatacggttagtcaagagttatttgcaacgagcatgattttgtcaggattatcgtccaatctatccactcttccgcaggaaaccttgcaggaacagctgatgctcgtgaaagacatgattgagtctgcccaaagagacctacgcatcctattattacatctacgcccaagtgaacttgaaagtaaaaccttggttgaaggatttgagttgattttgcgtgaagttagcgacaaaagtaatattatcgttcatttccaacatgaagtagaggagttaccgaaactaattgaagaacatctcttccgcattgcgcaagaaattatcagtaataccttgcgacatgccaaagccaagcatttggatgtttacctcttgcagaaggaaacagaacttcagttgaaaatgacagacgatggtatcggcttccaacaaggtgcagatgatgaattaagttacggtcttcaaaacatacgtgagcgggttgaagacatggctggaacgataaaaattcgcacagctccaaataagggagtggcgatcgatattcgtatcccactattgaaaggaaaagaagatgaatacgattcgagtgatgctggttgacgaccatgagatggttcgcctaggattgaaaagttacttaaatttacagccagatgttgaagtagttgcagaagctagtgatggcgaggaaggtttggctaaagcgttagaggttaaacctgatgttgtagtgatggacttggttatgcccaagatgactggcgtagaagcaactctggccttgctgaaggaatggccgcaagcgcagattgtcatcctgacctcctatctagataatgagaaaatctatcctgtgctggaagcaggagctcgtggctatatgttgaaaacgtcaagtgctgacgaaatcttagcagccatccgcaaggtagctcttggagaatatgctattgagacagaagtagagaaaaaagtagagcaccataaacgccacccagatttacatgatgacttgacagctcgtgaacgcgaaatcttgacgctgttagccaagggatatgataatcaacgaattgcagatgagtccttcatatccttaaaaactgttaagacccatgtttccaatatcttatccaaactagctgttagcgatcgtactcaagcagttgtttatgctttccagcatggtttggtggcgcaagaggaccaatagtggtataatgaaaattagttaatttttaaccaaaggatagtggaattatatggatgcaaaactcagatataaggcaaaaaaaataaaaatagtcttttttgacattgacgacacgctacgtgtgaagaatacaggctacattcctgaatcaattcagcaggtttttaaatcactgaaagaaaagggaattttgacaggaattgcgtcaggacgaacgccttatggtttggtgccagaaatcaaggccttaaagccagactttttcgctatgattaacggctcctacgtagaagatgccaaaggtcaggtagtgtaccatcagccgatgccccaaaatttagtagaatctgtattaaattgggctaaagaaattggaatcgaatatggtatgcttagtagtcaaaaagggacactttctgcacgaactgaccgtattagtcaagtaattgacttgatttatgaaggtttggaaacaaaaccaactttttataaagaaaatgatatctatcaattgttaactttcgagaaagatggtcacgaagtagaacttccagaagagttgcaagcagaattgcgtagtgttcgttgggatgctatttcatcggacattgtgttaaaaggctcttccaaagcaactggtgttgctaaggttgttgaaaaactaggcctgaaacctgaaaatgtcctagtgttcggagatggactcaacgatattgagttattcgattatgcaggaattagtatcgctatggggcattcgcatccagaattgcaaaagcatgcagattatatcacaaaaaaagtagaagaagatggcatttttgatgccttggagaaattaggtatggtagaaaaagaaaaatatttcccgcaattagatttggaaaatgttacaggaccagttgcgcatatcaagactaaccatggtaagttaacagtaaaactcttccctgaaattgcacccaaaactgtagcaaatttcgtagctctttctaaagatggctattatgacggaattatcttccatcgtattatcaaagactttatgattcaaggtggcgatccaaccggaacaggtatgggtggtgaatctatttatggtactgcgtttgaagatgaattttcaatggaagcttttaatctcagaggagccttgtcaatggccaatgcaggaccaaatacaaatggaagccaattctttatcgttcaaaaccaaaacttcccatacaatgcgaaagaattagaacgaggcggttggcctaaagaagttgcagaagcctatgtcaaaaatggcgggacaccatatctggatcaacgccacacagtgtttggtcatctagttgatgaagaatccttcgtcgtcttggatgctatcgcagcggttgcaacagattcagcagattgtccacatgaagatgttgtaattgagaccatcgaaatagaggattaagatgaaaatcggagataaactcaaggggacggtaacgggtattcaaccgtatggagcctttgtacaattagagaatgggacgacgggcctaatccatatctcggaaatcaaaacaggttttgttgataatatttatgatcatttaaaattggggcaagaggttttggtacaggtagttgattttgatgaatatactgaaaaggctagtttatcaatccggaccttagaagaagaacaacaaaaaattccgtgccatcatcgttttacaaatgaacggaataaaattggtttttcccccttagcaaaacaacttccgaaatggattgaggaagctaaaggctatctcaaagaacacaaagaaaagaaggtataggatgcattcctaaccttctttctttttaatcattgaactcataaagagctgttgacaagtaacgttctccgttatcaggcaagattgccaacacttttttcccagttcccaactccttagcgacttcgatagcagcgtgaattgctgcacctgaagaaataccaactaagaatccttcttttccaccgatagcacgacctgtagctaaggcatcatcggatttgacacgaataatgccatcataggcgctagtgtccaaagtatctggaataaaacctgccgaaataccttggatcttgtgcggaccaggtgcttcaccagataagacagctgattcatcagcttcaacagcatagatagcaatatctggatttgctgtcttcaaaacatgcgaaacacctgaaacggtaccaccagtaccaacgccagatacaaaggcatctaaaccagttgtgccaaagtcttccaaaatttcctgtcctgttgtatcttcgtgaacttttggattggatggattagcaaactggaaaggaacccagccatttttttcttcagcaatctcttttgctttggcgatagcccccttcatcccttcgctaccaggagtcaagacaagttcagctccataagcttggataatcttacgacgctcaacactcatggtttcaggcatgacgataatcacattataaccttttgctgctccaacccaagcaagaccgataccagtgttaccacttgttggctcaacaatagtatctccaggtttgattgtaccagccttttcagcatcttcaatcatagccaaggcgatacggtcttttacagaagatcctgggttaaaggcctctaatttcacatagacctccgctgccccctctggaacgatattattgagtttaataacaggtgtttttccaactaattgagtaatgttttgataaatagccatatggcacctccaaataatgttattatacattatatagtagaaagtcaaaaaaggataatataaaaaaactatctcgccgatagctttttttaatagacaggtacctcaacgattcgagagttagctttttccgtggatacttttccgtggtaaaagtcagtgagacttgctaaggtttgttcaaggaattctttatctacaaaaatcatggttgaaacttcagtagtaaactgggtatcaaattcttccagaccttgctccgctcgccaattggcaaactcttggtattgggcataggacatgctaagggaaatcccttcctgctccttaacttccacaaccccgatttccttgactgcattagccacggctccagcgtaagcacgaataagtccgcctgccccgagtttgatacctccaaaatagcgggtaaccaccgttgcgacattggtcagttcgtgattttctaaaaccgtcagcattggcacaccagcagtaccagacggctccccatcatctgaggaacgcttgatttccatattttctccaaggacaaaagcagagcagttatgagtagccttgtaatgctctttcttgattttgttgataaagtcgcgagcttcctcctcgctggtcactcgtttcataaagcagataaatcgtgactttttaatttcttcttcaacaataccatcttctctaattgttttaaattctttcataaccaaattgtactaatttttttaaaaactgacaagaaattccgaataaataagtgatgaaagaattagaaaattattatggaagattatttaccaaataccaattgacagcaaaagaaagagaaatagcagaaaaagtgccaagtattacaaaaaagaataactgctttcgctgtggaacaacttttgaagaagaaaacaaattgccaaacgatgcttattactgtcgagcctgcttgcttctaggcagagtacggtcagacgaaaaactctatcattttcctcagaaagattttccaatcactaagtgtttaaagtggaaaggtcaattaactgattggcaacaaagaatttcagatggactagttgcaaacgtggaaaataatcgtgcgacattggttcatgcagtaacaggagcaggtaagacagaaatgatctaccacaccgttgcctcagtgattgataaaggcggagcggtttgcctagccagtcctcgaattgatgtttgtatcgaactctataaacgtctgcaaaatgacttttcagttccaattagtttactacatggagagtctgaaccctatttccgaaccccattagttgtagcaaccacacatcagttattaaaattttatcaggcctttgatttggttttgattgatgaagtagacgcctttccctatgcagataatcccatgctctatcgagcagcagacaatgcggtcaaggaagctggtgttcaagtttttctgacagcgacttcaacagatgaattggataaaaaagtcagaacaggtaaattaagtcgtcttagtttgccaaggcgctttcatggcaacccacttgttgtcccgcaaaaagtctggtttagtaaattcgatgataccctaaagaaaaatagactagttccaaagttgaaaaaagcgattgaagaacagagaaagtcgtgctttcccttactcatttttgtcccagaaatctccaaaggtcaagaatttaccaagataatgaaaaaaacattcccagaagaaacaattggctttgtatccagtcaaacagaaaatcgccttgaaatagttgaagggtttcgcaagagagaaatcacagtcttaatctcgactactattcttgaacgtggggtgaccttcccatgtgtagacgtctttgttgttcaagccaatcattacctctacacagtgtcaagtcttgttcagattgcaggccgagtcggaaggagtatggaacgtccgactggtttactccagttttatcatgagggaagtacaggagccattgaaaaggcagtcgctgaaattaaacagatgaacaaggaggctggttatgtctaattgcctattgtgcggtcaagctatgaaaaataaaacaagattttcagatctcatcttctttagtaaagaaaaatcgggcatctgtgaagaatgtttttcgacttttgaggaaatagcagagcaacactgtccacattgttataaaaatggggaatcggaaagttgcaaggattgtcagtactggcagaatcaagggaaaccagttgtccacacagctttgtaccaatataatcaagcgatggcgcattattttagtcgctacaaatttcaaggagactatgttttaagaaatatttttgctaaaaagcttagaatagcgttaagccaatttcctgactacacaattgttcccataccaattagtcaaaaacgactatcagaacgcggttttaatcaagtggaaggacttttggatgctacaaatattccctatcagtcccttcttggaaagtatgaaagccaaaaacaatcatctaaaaatcgtgcagagagactagaagcaaaacagatgttctatctattagatgaaaaagaagtgccagaaaaaatattattattcgacgatatatatacaacaggagccacaatccaacttgctgtagaacttttcatgaaaattggtaggaaagaaatcaaaacattttcactaacacgataagaaaacggttgcaatatccctataatgtggtataataatagtgaagaaaggcgaaagccaagaaagaggtactaatatgattaaattcagtattcgtggagaaaaccttgaagttacagaagcacttcgcacctatgtagaagagaaagtggctaagattgagaaatatttcaatgaagaacaagagttgaatgctaaagtaaatctaaaagtttaccgtgacaagcgtgcaaaagtagaagtgacaattccagttggagcagttacacttcgcgcagaagatatttcacaagaaatgtatggctctatcgatcttgtagtagataagattgaacgccaaattcgtcgtaacaaaaccaagattgaacgaaagcatcgtcaaaaagtggcaactggtcaagtctttacagatgaacttgttgagcaaacaggcgaggaagtaaaagtggttcgtactaagcaagtagacttgaaaccaatggatatggaagaagcagtcctccaattggagttgctcggacatgatttctttatctatacagatgctaatgacggtacaacaaatgtattgtatagacgcgaagatggagatttgggtcttctagaggtacgtcaataaagataataaaacagttgcagtttttgcagctgttttatcattttcaaaaaaccggttgacaatgtatataagtcgtgatagaataaatgagttgtctcttgagggactagttaacagagaaacgaaaaaagtttcaaaaaagtgttgacaaagttcacaagaaatgataaactaagatagttgtcgcgagagcgcgataacgacaagacctttgaaaattaaagaagacgaaccaaacgtgcagggtgatttatctaaagataaatcgtcaatgacaaaacaaaacaataaaacggaaagctagcaatagcttgagtttgaatcaaaactttttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaaatggaaacctgtacgtcagtcttctttaattttgagaggtcttgtggggccttagctcagctgggagagcgcctgctttgcacgcaggaggtcagcggttcgatcccgctaggctccattaacaacggaagttgttaagattttgtccattgaaaattgaatatctatcaaacattcctaaacgtatgtaaaagtacgtatagaaatagtaacaagaaaataaaccgaaaacgctgtgaatatttaatgagttttctaatttttgaaaaaattaggttaaaacaagttacgaagacgttaaggaaaacgtatgattttaggaaatcatcgcagtagtctaaggactacaagaggatttgtctaaatcactagttttctagtctgagtacgattataaggttaagttaataagggcgcacggtggatgccttggcactagaagccgatgaaggacgtgactaacgacgaaatgccttggggagctgtaagtaagcaatgatccagggatgtccgaatgggggaacccggcaggtaatgcctgtcactcactactgttaaggtagtgaagaggaagacgcagtgaactgaaacatctaagtagctgcaggaagagaaagcaaaagcgattgccttagtagcggcgagcgaaacggcaggagggcaaaccgaggagtttactcctcggggttgtaggactgcaatgtggacttaaagagtatagaagaactacctgggaaggtaggccaaagagagtaatagcctcgtatttaaaatattttttatacctagcagtatcctgagtacggcgagacacgcgaaatctcgtcggaatccgggaggaccatctcccaaccctaaatactctctagtgaccgatagtgaaccagtaccgtgagggaaaggtgaaaagtaccccggaaggggagtgaaatagaacctgaaaccgtgtgcctacaacaagttcgagcccgttaatgggtgagagcgtgccttttgtagaatgaaccggcgagttacgatatgatgcgaggttaagttgaagagacggagccgtagggaaaccgagtcttaatagggcggattagtattatgtcgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacatttgagaatcttggaggtagagcactgtttggatgagggggccatctcggtttactgatttcagataaactccgaatgccaatgatttatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggataacactttagtgttatggtaggagagcgttctatgtgtgaagaaggtataccgtgaggagtgctggaacgcatagaagtgagaatgccggtatgagtagcgaaagatgggtgagaatcccatccaccgtaagactaaggtttccaggggaaggctcgtccgccctgggttagtcgggacctaaggagagaccgaagggtgtatccgatggacaacaggttgatattcctgtactagagtatgaagtgatggagggacgcagtaggctaactaaagcgggcgattggaagtgcccgtctaagcagtgaggtgtgatatgagtcaaatgcttgtatctgtaacattgagctgtgatggggagcgaagttaagtagcgaagttagtgacgtcacactgccgagaaaagcttctagcgatgtatcatactctacccgtaccgcaaaccgacacaggtagtcgaggcgagtagcctcaggtgagcgagagaactctcgttaaggaactcggcaaaatgaccccgtaacttcgggagaaggggtgctggcttaaagtcagccgcagtgaataggcccaagcaactgtttatcaaaaacacagctctctgctaaatcgtaagatgatgtatagggggtgacgcctgcccggtgctggaaggttaagaggagggtttagcgcaagcgaagatctgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtatctgtaccacatgtacaggataggtaggagcctacgaagtcgggacgccagtttcgactgaggcgctgttgggatactacccttgtgttatggctactctaacccggataggttatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggacgggataaacgctgaaagcatctaagtgtgaaacccacctcaagatgagatttcccataactttatgttagtaagagccctgagagatgatcaggtagataggttggaagtggaagtgtggcgacacatgtagcggaccaatactaatcgctcgaggacttatccaaagaaataaactagagtcaatattgacaagcgatcggtttcttgttagaatatagatattcaattttgagttgacaagactcagtagttaagtgacgatagcctaggagatacacctgtacccatgccgaacacagcagttaagccctagaacgcctgaagtagttgggggttgccccctgttagatacggtagtcgcttagcaaattgggagtttagctcagctgggagagcatctgccttacaagcagagggtcagcggttcgatcccgttaactcccataggtcccgtagtgtagcggttatcacgtcgccctgtcacggcgaagatcgcgggttcgattcccgtcgggaccgttgaaacgaatcaatcatatgtttcaagtaatataattaagtaaagactcgttagctcagttggtagagcaattgacttttaatcaatgggtcgctggttcgagcccagcacgagtcatatgcgggtttggcggaattggcagacgcaccagatttaggatctggcgctttcgggcgtgggggttcaagtcccttaacccgcatagaatggaaataggccggcttagctcagttggtagagcatctgatttgtaatcagagggtcgcgtgttcaagtcatgtagccggcattaggaaagattgcgaacgtagttcagtggtagaacaccaccttgccaaggtgggggtcgcgggttcgaatcccgtcgttcgctttgagaggccggggtggcggaactggcagacgcacaggacttaaaatcctgcgatggcaacatcgtaccggttcgattccggtcctcggcatgaagattataatagttagcacccttagctcaactggatagagtacctgactacgaatcaggcggttagaggttcgaatcctctagggtgcatcactcgcttaatggagacgttaggggagctttatttttaatagtatcgggaagtagctcagcttggtagagtacttggtttgggaccaaggtgtcgcaggttcgaatcctgtcttcccgattattgtaagagagcagcaatgttctttttttttggctctttgtcaactgtagtgggtagatgaaaagctaacacctagagaggacgaaattcgttctctctttcttgtttttaggagatgagctgaaaagagctctcctcagcttttcactgttcaaagcatcaaaatccgtttttctagtttccattttcctgaatccaaaggcatttcttttaatgactttgatgagattgttagttgtttctgatttggtgttggaaattgtgagttttgttgtttttcatactcaataaaaatcaaaaatagcaagtctaatttacttataacatgtaaaaccttaatttataagtttgagttgaggattgtggatttcaagtagctgtttttttctcaaaaaataacaaaatcaaaatgctccatatctactttgagtggtaggtggctatttttgattttaaatgggtatcagtgtaggtcgtaggggacttttttctacactcaaaaaggctctatatgaccatagtgggtttacccgtcatagtcttatagtgccttttattttttgcttagtttaacaaccgcctcggtccgtgctgtgtggggaaacatgtcaacagattgaatgtattctaccttgtaggctttgcttagctcaacaaggtcccttgcaagagtggagacgttgcaggatacataaaccattttagctggtttgtaattcaaaatggttttgaggagcttttcgtcgagtccagttcgtggaggatcaactaccaaggcatcggccctgtagccttcttggtaccactttggaatgatttcttctgctttacctgcctcatagtgggtattggatagtcccattcgcttagcgtttgctttagcatcctcgatggcttctggaataatgtccatacctcgaacagatttgacctttttagcaaaggcgaagccgattgtacccacgccacagtaggcatcaatcaagtcttcatctcctgaaatatccaaagccttgacggcctcgccatagagaatttctgtttgttggggatttaattggtaaaatgcccgtggagatagtgagaattcgtaatctaaaacagcttcatcgatagcttgttctccccataaaatttctgttttttcaccataaatatcactcgttttctgtctattccagtttagagcaatagtgattatacttggaaattgactggtgagttcatcaattaatttaataagattaacctgacaagaggtgataaatatcacttgaacttgacctgtttttcgagccttgcggaccatgaccgtgcggattccatgttgcttgcgctcattataaataggaatacggtgcttggtgagtagctttgcgattccgttgataatctcttgtgtttcggcatcttggacgtaacaattcgtaattccaatcaagcgatgggaattttccgcatagagaccggccttgacttgatctttgaaagatcgagtctggaactgtaatttggcacgatagtggctaggcttatccataccgattgttggataaatagtatagttttcgtagccagctggtttgaacttttttagggcctgctgcaagagatcttgtttgaagtctaattgtttatcatagcggaggtgcatgatttgacaaccaccacaggctcgatagatgtcacaggccggcttgacacggaattttgattccttgttgatttttaacaattttgcttcaacgaaatttcgtttgactgaggtaatttgacaaaaaatttcttctcccttaaggacaccagggacaaagactagcgttttttgataaaatccgatgccttctccgttgatgcccattcgtttgatttttaaggggattcgttggtttacttgtagattcatattattattttaccgaaaaatcctgtataatgaaagaatgagaattacaaaaattgaaaagaagaaacgtctttatttacttgaagtggatggtcaggatagtttatatattacggaagacacaattgttcgcttcatgcttagtaagggaaaggaaatcacggagcaggagtttcgtgagcttcgcgattttgctcagttttcttatgggaaaaatctagcactttattacctttccttcaagcaacgtaccaaaaaagaagttagtaattatctaaaaaaatatgaaattgaagaaaacaatattgtcaagattgtgacggtattagaagaggaaaaatggctggacgatgggaattatgttgatagctatgttcgtcagaatgctctaaatggagataagggaccagctatgattcgtcagaagttgatgcagaaaggaattcctaaaacgctgattgataaaagactggctgaggaagatttttcagagcttgctgggaagattggggagaaattggtgggtagataccaaagaaaattgcctcttcgagctttgcaagataaagttgtacagggattgatgggtaagggtttttcttatgaggcggccaaacaaagcctgggtcagttggaacttgtggctgatgaggaaaatgaagatgatttaatcgccaaggaattggataagcagtatagaaaatatagtcgtaaatatgaaggctatgaattgaagcaaaggttgatacaggctttggctcgaaagggttatgactttgatcggattcaggctgtccttcgtgattatctgtgaaaaaatttagcctaggttagaaaaatatgatataatagtcaagataaattgtaattgtagaaagttggtaacaaagtgaaattaccaaaggaaggcgactttattacaattcaaagttataagcatgacggtgaaattcatcgcacttggcgtgacaccatggtattaaaaacaacggaaaatgctattattggagtcaataatcataccttagtgactgaaaatgatggtaggcgttgggtaacaagagagccagcaatcgtttattttcataaaaaatactggttcaatatcattgcaatgattcgtgaaaacggagtttcctattattgtaaccttgctagtccatatgttctcgacaatgaggcactcaaatacattgattatgacctagatgttaaggtctttgctgatggtgaaaagagactgctggatgtggatgaatatgagcgtcatcgtaaggcgatgaagtattcggatgatattgattttattttgaaggaaaatgtcaagatactggttgattggattaataaccagcgcggaccattctctccagcctacgttaatatctggtacaaacgctatttagaactgagaagtagataaagttagaaaagaaaatcctgttttacaggcttttttcttattgtaaaggaggggcttatggcctttgaacaaacaaatgggcgctatgcaagttttggagttgtgacttcgcttcctggggaagtgattgatagtttctggtatgttattgatcactacttaaaaggggttattccattaaaaagtgtaatccgtttttctatcaaaaatcgtcgtggtaagattacgctggtcttttcgcaggaaggttataaaaatgtactggctgtagatctaagtagtcgttttgatcctttttatccctcaacaatcttggtaatggacaagcagggaaaagagaccattactttgccagatgaggtaaccttgctttagcttgaagagctggtattttatcacccaagatattgttaatatatgaaatttggtgtaaaatagatttgtaagcttatgtgggttagaaaggaggagtctatggttagtcaaactgttgaaaaacctctctatttgcagttggttgatgaattagaagttgcaattcgtgagaggatggctccgaatgacaagttattttcagagcgtgagttgacacaggtttatggtgtcagtcgtattacagttcgtttggctttgcaagaattggaaaaacggggcttagtctataagaagcatggtaagggaacctatgtatctgagatttcagatactgcagttgatttgtctcaggcctatagttttactgagcaaatgaaaaaaattgggaaagtaccgaggacatctattttatcctttgaattggttaaggcgtcagactatattgcgcagcatttacaacttagtcaaggtgaggaagtgtttgaagttgaacgattgagacttgccgatgagattccgatgatgctggaaaggacatatgttcctgcttcggtatttcctggattagctgctcagcgaatgaagtcaactcccttgtatgaaattttttcagaggattatcatcaggtgattcgtttggcagaagaagagttctatgcaagtattgctttggataatgaagctaagatactcggaattccaagcaatagtccagtgcttcatttggtaagaaaaacgtataatgataagaatagaattatcgagtttacgtttagtattgctagagcggaccagtttcgttacaagattacccatcaacggggatattagaatcaatactcttcgaaaatcaaaattattcgttgtcaagagccttgatgaaatccagttctatcttcggcttcgtttcctaggctacttttgattgttattgggtatgaaaaaaacgcggacgttagtctgcgtttttttagcgatggttggctgtaatttcaaatttgtaatacttccagtgcttgtaagtttcagtatattccatcacttcaccgctagtactgttagtagttgttttgttttgtagtacagctggttcagtcgcttttaatttcaaatgggtggcaacctcttttggacatgggctgacaatttcattcgtttctacaaatggttcctcggacatgtggatattgtagtccagtttgaagcgttgatagattgattgatagtgctcgagtggagcatcgggattctggatatatcgttgagggatgtatgaattgtggaagatgtatggagtgtcttctgctgcgcggacgcgtacaattttatagtaaaactcattcttgtcaagatttagtttttcaaggatatcgggtttattgcctttttcgcacgagagaacagtaaccttatccttatccatcggaaaaatctcaatatcagaaaattctacaagacgtcctttacgtgaacgagatacaaaggttcctttaccttgttggcgaacgaggtaaccatctttaactagttcgtttactgcacggataacggtaatggagctaacattaaatagttttgttaattcagattctgtgtaaaatttgtcgccattttcaaatttgccagaaacaatctgttggcgtaagtcgttttgtataagttggtacttcggtactttcatacttatttccttcctttccacaacttattatactaaattagttgatgaaaatcaaaaaatatagctaaaatacccacaaaaatatactttttcactttataaaggtgataagaaatggtaaaaaaatttttaaaaagtactggacataaccacaaagaagtgttagtatattaatagaaaggtaagcggttgcatcggaggaagaaatgaaagaattttatattggagaccaattttatttggacggtgaaccctttaagattttatcaggcgcgattcattattttcgtgtccatcctgatgattggtaccattctttgtataacttaaaggcccttggttttaatacggttgaaacctatgtcccttggaatatgcatgagcctcgaaagggtgagttttgttacgagggtatattggatattgagcgatttttgaaattggctcaagaattagggctttatgcaattgtacgaccgtccccctatatttgtgctgagtgggaatggggtggcctccctgcttggttgatgaaggaagagcttagagtacgttcgagtgattcggtgtacttgcagcacttagatgaatattacgtttctcttattcctaaattggccaagctccaactcgcacagggtggaaatgtacttatgttccaagtggaaaatgagtatggatcttatggtgaggagaaggcatatttaagagcggtggctggcttgatgcgtaaacatggtctaactgctcccttgtttacctcggacggttcttggcgagcaacattacgtgcaggaacactgatagaggacgatgtatttgtaacaggaaactttggttctaaagctagagagaattttgcaaatatgacggcattctttaatgaacatcagaagaattggccactcatgtgtatggaattttgggatggttggttcaatcgttggggcgatgaaattattcgtagagagccggaggaaatggttgattcagttatggaatgtatcgaattgggctccttgaatctgtacatgttccatggtggaacaaattttggtttcatgaatggttgctctgctcgtggtcaaattgatttgcctcaggtaacttcttatgattatgatgctatattggatgaagctggaaatcctactaagaagttttatattttgcaacaacgtttgaaagaagtctatcctgaattagagtatgcagaaccgcttgtaaaagaggcaaaagctttttcagatgtgtcgcttcatgataaggtgagtctgtttgctactctagaaaatgtaagcgattgcgtaaaagggttttatcctaagaatatggaagaacttgatcagtcaacaggttatattttatatagaacagagttggagcgggataagacagaagcagaacgtttccgagtggttgatgcgcgtgaccgtatccaaatttatgcagatggaaaattcgttgcaactcagtatcagactgagattggtgacgatgttgaattggattttaaagatgacaagctaacattagatattttggtagaaaatatgggacgtgtcaattatgggcacaaactaacggctcctacccagtctaaagggattggtcgaggtgcgatggctgatttacattttattggtcattgggaaacctatcctttgcatcttgagtcagttgaggacctggattttagtaagggctgggaggaaggtcaagctgctttctatcgttatcagtttgaactggatgaacttgcggatacttacttagacatgacaggttttggtaagggagttgttttcgttaataatgtaaatattggacgtttttgggaaaaaggaccaatcctctatctctatattccaaaaggatacttaaagaaaggagcgaatgaaatagttgtcttcgagacagaaggaaaatatagagagaagattcatttttcacaaagacccgttataaaagacttgtagaaattttaatcggtttctgctcaaaagatttatgaagaaaaggagaacactgtatggcaattattgctacgcgtattgatggtcgtttgatccacggtcaggttgctaacttatggacgacgaaattgaacatcggtcgtatcatggttatcgatgatgctgttgctcaaaatgacattgaaaaacaaggactgaaattagcatgtcctccaggcgtaaaattatcgattttaccgatcgaaaaggctgctaataacattaaggaagggaagtacgatagccaacgtcttttgattgttgcccgtcgtcctgaaaacttcctacgtttagttgaatatggagtggaattggcagaattgaacgtagggaatatgtctcaaactccggaaactcgttctgtaactcgttctattaacgttgtagataaggatattgcagattttgatgccttggcggctaagggtgtaaaattatttgcacaaatggtacctggcgattcaccaaaagactttatgccattattggataaggttagataacattcggatatttttgaaaaatttaaaggaggatcactattatgcaatggtggcaaatattacttctaacgctctactctgcttaccagatttgtgacgagctgacaattgtatcgtcagcaggttcaccagtctttgcagggtttatcactggtttaatcatggggaacatggaagttggcttgctaattggtgcaagtttgcagctagttgtcttgggagttggtactttcggtggtgcgtcacgtattgatgcaacatctggtgcggttcttgcgacagctttctcaatttcacaaggtttagatccagaaattgccatttccactattggcgtaccagttgcaggattgttggtttatacagatattttaggtcgtttcaccactactttctttgctcatcgtgtagatgcagcaatcgaacgttttgactatgctggtattgaacgcaactaccttcttggtgcaattccttgggcactttctcgtgcacttccagtttttcttgcccttgcttttggtggtggtcttgtagaaactcttgtcactacgattgagttgcctgaatacaaatggattgcagcaggcttaactcttgcagctcgtatgcttccaggtcttggatttgcaatcttacttcactatcttccacttaaacgtaaccttcactacttggcggtaggtttcgctcttacagctatgttgactgttctttacggtaacgtatcagctttgggtggtgcagttgctggtatcgttggcactcttcctgaagatgcaggcgtaagctttgtcaataacttcaaaggtttgtcaatgattggtatcgctattgtgggtgcatttctttcagtgattcacttcaaaaatagccaaaaagtaactgtggttgctccatcaaattcagaaagtggggaaattgaagatgacgaaatctaattacaaattaacaaaagaagattttaatcaaatcaacaaacgtagcttgttcactttccaacttggttggaactatgagcggatgcaggcatctggctacctctacatgattttgccacaattgcgtaaaatgtatggagatggtacacctgagttgaaggaaatgatgaaattgcatactcagttcttcaatacttcaccattcttccataccatcatcacaggtattgacttggcacttgaagaaagtgatggtgttgcttctaaagatgcggttaacggtgttaagacaggtttgatgggaccatttgctccaatcggtgactcaatctttggttctcttgttccagcgattatggggactgtggctgctactatgggtaaagagggatctccagttggtatctttctttgggtagcagtagccattgcctatgatattttccgttggaaacagttggaagttgcctacaaagaaggtactaagttgattacaaccatgcgcgatcgcttgacagctctcgttgatgcagcatctgtaatgggtgtcttcatgatgggtgccttgattgcaactatgattaactttgaagtgacttgggctccagctattggagaaaaagtgattgatattcaagacattttgaataccatcttcccacgcctagtacctgcaatctttacaggatttgtcttctggcttcttggtcgtcgtggcatgacttcgactaaagctatcttgattattattgtgcttgcacttggcttctcagcaatcggtcacttcctatttggtatggtataatggttagaagtttagtattagtaagtcatggtatcttctgcgaggagttgaaaaaatctactgaaatgattatgggtcctcaagaggacatctacacagtagctttattaccagaagaaggtccagaagacttccagaaaaaatttgaagaaacaattgcaggattggaagattttgttgtcttcgcagacttgttgggcggtacaccagccaacgtcgtatcacgaaaattgattgaaggtgggcagtttgacctttatgcagggatgaatatgccaatggttatcggtttcttgaacggcgtcctgctgggagaggctgtggattatgtagaatttgggacaagcaacctagttcatgtcaatagtctattaacaagtgatgaagatgacgatgagtgaaacagtttgggaaactgtttccactggtcaccttgaaatgaaagagtgaccaaagacagcccgagcctagaaataagagagtgaggctaactcagctgattgttacagacggatttgattttcgttaattataaaatgttctatagttgataggctttaagtatcctgaggaagttgcaatagtgactccctcatttggcttgtgaggaaaagaaatgattgaagtaaaaacatttgatgaaaaagcaaaactgtattgcttggaaaacaagaatgggatgcaggtaaccttgacggattttggtgccagagtggtggaagtgcttttgccagtagaagaaaatggcggtctacggaatgtcagtttagctgccaagtcggatgatgattaccgtaagacagatttgtaccctggttcaactattgtcccagtagcggggcgtatttcaggtgcccaagctgagatagagggaacaagctaccatttcacagaaaatgaacctggtaggactctacacggtggggttgacacggcaaatgagcagtactgggacgttgagctagaccatgagagaaatcaagtgacctttggtatggtcctaaaagatggttttaatggctttcctggtgatgtgagggtcaaggctatttattgtttgacggataaaaatgaattgacagttgactaccaggctgtatcggataaggatacgatttttaatccgaccaaccatatctatttcaacttgactggtgattttcaacggtcagttgccgagcaccgtattaaaattgctgccaatcactatgctccgcttggggaggataacctgccaacgggtgtcttagaagatgtgacagggacgccgtttgattttagagattttgcgccttttgctcagggatttgatagccaatatcctcaaaatgtgttggtaaaaggctatgaccacccatggttattggaagaggtggatattccggtagaagttttgagtccagatgggaaaattggactcagtgtcaaaaccaaccagcctgcggtcgttatttatacatataattttcctgttgaagctttggcctgttaccatggtgtctttagtttagagtgtcaggccttgccaaatgcatgcaatgtcgatggatttggttcgattttgttagaacaaggagaagaatttttgtctaaaacgacctatcgttttacttggtaaaaaaatggggactctaactgtgttacagttagggttttcttgtgttttctagaaaatatggtataataaaccggtgtgtttcaatcgaagcaggcgaaagaggaaaataatgacaaaagaacaagaatttttaaaagaatttgaggcttgggtcaacactcaggtcatggtaaacgagatggcggttgaagaaagtcgtcgtgtcttggaagaagacaaggatgagcgtgcagcggatgcttatattcgttatgagagcaagctggatgcctatcgattcattcaagggaaatttgccaactaccatgctggcaaaggttttcatgatttgccagatgagttgtttggtcaaaggcattattaaggagaggagttaacatggcaaagaaaaaagtaaatcgaaaaaaacaattgaaaaaacaattagcagacttgaaacgtgcaggtcgtgtaggtcttgaaagagctgcagaggtagtagagacagttgctcacaaggctgaggctgtagtagagcgtactgtggaacaagtgaaagaagttgtagcagaggtgacttcttcagcgacttcattggaagactttttggcgcttcctgagttggaaggcattgcggcagcacgtttggaaaccttctacgaagcaggtattcaatctgtggctgattttgcaaaccatacagaaaaagagctcttggctcttaaaggcatcggtcctgcaactatcaagcagttgaaagaaaaagggattgagctgaaagcttaaatcccttgcttttcaaggtacaatttgttacaataaagccattcagaggtgttttgagccccatttgtcacaggaagcggtggtactgagaaatccgcacaaatgtcaaaactggttgctgatgatgtgaatcgaataagcaaagtgcagataatgtatctgaacaagggtggtaccgcggaataacttcgtccctgtctagcaagtctaggcggggattttcatttggaaaggagaagatatgttacatcatgttgaaatttacgtttctgacttggaaacttcgcgtgcattttacgactttctcctgaccaagctgggctactcgctctatcaggagtgggataaagggctgtcttataaaaaagcagagcaatacctggtctttgtccaaacgccagaggacttcctagaggtaggctaccaccgttgccgcacaggtctcaatcatctagcttttcatgcagggacacctgatgagattgaccaatggcggaaggaatttttgaccagacgagtcaaacttctctacgacgaccgctatccccacgcaggaggaccagaccactatgccctttatttggaagatccagatgggataaagatagagttggtgggggagggggtatgaatctaattattattggagcacaagcttctggcaagatgaccgttgggcaggaagttgcgaaattgacagggatgaccctttttcataatcacgattcgattgattttagcctacgttttattcctgaattttctgaggatatgtttgacctcaatacacgtattacatttgctgtttatgatgtgtttgctaggtcaggccgtccactaatcggaactgccttgattaattttaaaaatctcatagaggttcaattccttacaacagttcagacgatttttcatcatcatggccaggaaattttatttgttgagttggaaaccgctttggaagaacgtttgcggcgtaatcggacagaaaatcgacttacccataaacctttgaaacgacacattgaagtttcagaggctgagattctctctacagctgatacatgtcgatatacctcgttaggcattccagagggcattcagcattatctcaaaattaataatactcatctttctgccaatgacgtagctcaactaattatccaaaaaatggaggaacttgagcaagaacaaacgaaatagccagcccaaaggactgactatttctaggagattatatgaaaaagaattgggctatttctagcttgaagatagtataaaccaatttttttaaagaatactgaaggagaaaaaataatgtcaaaagaattatcaccaaaatacaatccagccgaggttgaggctggtcgttaccaaacttggttggaccaagatgtttttaagccgtcaggcgatgcggaggctaagccttattctatcgtgattccacctccaaacgtaactggtaagttacacttgggacacgcttgggatacaacccttcaagatatcatcatccgccaaaaacgcatgcagggatttgataccctctggcttccaggtatggaccacgcggggattgctactcaggctaaggttgaggaacgcttgcgggagcaaggcgtgacccgttatgacttggggcgcgaaaaattcctcgataaagtctgggaatggaaggatgagtatgcagcgactattcgtgaacaatggggcaagttgggtctgtctttggactaccaacgtgaccgcttcacgctggacgaaggcttgtcaaaagccgttcgcaaggtctttgtagaactctacaaaaaaggctggatctaccgtggtgaatttatcatcaactgggacccagcggctcgcacagccctttctgatattgaagttatccacaaggacgtagagggtgctttctaccacatgaattatatgttggaagatggttctcgtgcccttcaagttgccacaactcgtcctgaaaccatgttcggtgacgttgcggttgcagttaacccagaagatccacgttacaaggacttgattggtaaaaatgttatccttccaattgtgaacaagccaatcccaatcgttgcggatgagcacgcggatcctgaatttggtacaggggttgtgaaaatcactcctgcgcacgatccaaatgacttcctcgttggacaacgccacaatctgccacaagtcaatgtcatgaacgacgacggtactatgaacgagttggctggtgaatttgcaggcatggaccgctttgaagctcgtaaggcaacggttgctaagttgcaagaactgggtgcccttgtggaaatcgaaaaccgtgtgcattctgttggacactctgagcgtacaggtgtggtagtcgagccacgcttgtcaactcaatggtttgttaagatggaccaattggccaagaatgccattgccaaccaagatacagctgacaaggtagaattttacccaccacgcttcaacgatactttcctacaatggatggaaaatgtacacgactgggttatctctcgtcagctttggtggggtcatcagattccagcatggtataacgaatctggcgaaatgtacgtcggagaagaggctccagcaggtgacggttgggtacaggatgaggatgtcctagatacctggttcagctctgccctttggccattttcaaccatgggctggcctgacgaaaacgcggcggacttccagcgttacttcccaacctcaaccttggtaacgggctatgatattattccattctgggtgtctcgtatgattttccaaggaattgaatttacaggcaagagcccatttaagaatgctctgattcacggacttatccgtgacgaagaaggtcgcaagatgtccaagtcgctcggaaacgggattgacccgatggatgttatcgagaaatacggtgcggacgctttgcgttggttcttgtcaaacggctctgcccctggtcaagatgttcgcttctcttatgagaagatggacgcatcttggaacttcatcaacaagatttggaacatttcccgctatatcctcatgaacaatgaaggtttgaccttggatgcggcgcgtgagaatgttgccaaagtcgcagctggcgaggctggcaacgtgacggaccgctggattctccacaacctcaacgaaaccattgccaaagtcactgaaaactttgacaagttcgagtttggtgtggctggtcacatcctctacaacttcatctgggaagagttcgccaactggtatgtcgaactgaccaaggaggtcctttacagcgacaacgaggctgagaaagtcatgacccgctctgtccttctctacacgctggaccaaatccttcgcctcctccacccaatcatgccgtttgtgacggaagagattttcgcccagtacgcagagggttctatcgtggtagcggcctaccctgttgtcaacccagcatttgaaaatgcggaagcccacaagggagtggaaagtcttaaagacttgatccgttcggtgcgaaatagcagagcagaagtcaatgttgctccttctaagccgattaccattttgattaagacggcagatagcgagcttgaaaccttcttcaaggcaaatgaaaactacatccgccgctttaccaacccagagcagttggaaatcagctcaagcatcgctgcaccagaactagccatgtcagccgttatcaccggtgctgaaatcttcttgccactagcagaccttcttaacgtcgaagaagagttggctcgtctagacaaagaactcgtcaagtggcaaaaagaactagacatggtcggcaaaaaactcagcaacgaacgcttcattgccaacgctaaaccagaagtcgttgaaaaagaaaaagaaaaacaagccgactaccaagcaaaatatgatgcgacagtagcgcggattgaagagatgaagaagttggttaagtaggtagaatacgataaaatgcccagcctaaaatggctgggttttgtggtataataaaattaatacattaggagttttatatgatgattatattaatttgtctttccttatttattataagtagaacaatgaatggctttcgattatttctagattctacaattattatagggtttatttgtctgtttttctattattgttgttttgacttaatttttattagcttgacaaatttggttttaatactaattttgttagtttattctttctcagacatcctttttggaattagaataataggcctaagtataccatttattagaagtattgttctaaaatatattgactgtaagggatttttacaaaataaaataaggaatcacttagttgaaattagagaaattatattagttacattcctttttctgatttttggggttcaggttcaacttcaactaccctatatcaattttactaattatagtttaatagaaatattaggatttgatatcgcaatttttagtttatatggtatctatgtagcttttttacagtttttaactgaaaatgataaagtttattacttaggtgttagtaagattcgcttcatgctagataattcagtgtggtcgcagctaaccagagctaaattatttcatattattctattagtgtcggtattaataccgttgttcagcaaaagtaatatagaatttaattatcagcttcagaatatagaatatctgtggcaaacctgttacattatttctatcgtggtttatatctttttgctgaaacttagtatcagtattgtatatggggtttttagattaaatttagaaaatgtaagtaagacggttaaaaaggaagatgttaaggaaaaagatagtagacataaagaaaaaatttttaatagatttggtatcactgataaaattaatatctcagtacaaaggtcctttaaggatgagttttggaaaatttataaaaatcaaaatcaatatagggatgattatataaaagtaagacttcaagagagaattacattggttgagaaagctgatagggatgaattaatttttactatttttggcagagaaaattgggaaaattataacttatcagaaagtatatttgtatttatagaaaatatagatagtgatgaaggcaaacaattctttaggttttataagaatttttgtatacataaatggaattttttaagagattatcaaaccgatatatcccctagaacatgggtaaaactagtagagcaggatattcttatttttgacaagttagttaaatccgattctacgttcaacatattcaaaattgaattttcagataatgccatatcacgtaatttgaatcttgaaaaaaataagaaaataaaagaatttttatttgaacttttacttgataaagaaggtgtcaatttagatgatgtattaataagtataaaaaaggaaatacaacgtttttcacagaataaatcagatcaattttatagatatacatatgattttttaaaatttagattagtaacaattttagataagtatgaaaatgatgatgtaaatataaatttaccagaatataaaagtctatccgatgcgtttcaaaatggccagcgaaatgattatgaaaacagtatgctttattctaaaatttgtttcaattatttagatagaggaagaattgaagattttagtcatacaaaagttgaagcagatgatagtaaagagcgggaaaaacaaaaattaaaagctcaaaaaatacagggattgattctgagcatgaatgaagaataccgaatggcatttatgctatatcaattattttatacggatcgtactcaatgggatgagaatctggcattttacgataataatattcaaagtataatgaagcatggtaagcaataccatggttatttattcgatcaagtgaaaaatattattctaagtgagactgatattgatcatcgtattacagaatcttttttagacaagatatgggaaacaaaaaatgaaacaattatggatttttcatggtttgatcaatttggggatcaacatcagatgtcgaattttaaaattctttacgtacaatggatattatcaggagcgacaacttcctatttgaagagtagaattaattttgaaagagggtttcctattaaagtacgcaattcacttgttggaaaaataaaaggaaaagaaaataggaagatgtcagttaaagatttgaaatggaggattagacgtaaagaagaaaggattggtcatctttgccgagactatctattattaacagatcagttaacgactatttttacaaaagtaccatctgataaacataatttacaaatatcagttgaatatcttttgcacagtggtaaagtgaatttatcggatgttatagataatatatcagtaacaagtttacttcgcttggaatggcttttgagatggaactattatcattatcatagggagtcaaattatactagcagaacattctttgacgaaatgacctctaatgaccgatattattggtctgctggacgtggtattttagaatttttcattgccaaaattgttgacaatttttatcgtgatttataccaagataaagagtttatggctggttttaaatatcatttagagtcacaattaaattcattaaataaaacagttgaagagtatgtggagttgattgctgaaagagtttctggaattgataatctttcaattctacagaaaggacaaattatttccaaattgaattatattttatttggtcaagataataatattaaaataagacaaaaagaaaatatcgctataaataaattttaagagctccattggacatagaaaaacttgagattttatcaagcgttaccaatctggaaatcgtctaaaaataaaaacaagctgactaccaagcaaaatatgatgcgacacaggagcggattgaagagatgaaaaaactggttaagtaggtagaatacaacaaatgcccagcctaaaaaggctgggttttgtggtataataaggttagaaattcaaacaggaggagtctatgcaaccaacttacaatattgataatcccaatctttcctacgaagccaagcaagaactctgggaaacgggttttggtcttcaaaaagtggatgggttgactccgtctgtttatatggaggagttggcggaaaggcaagctcgtggagagtacacctatgagcaggtgtacgaggagattacgaaataccaccagtcaactgacgccagtacgcaagaggcagacattgtctctctccgaattgttgaaatgctctcccaaaatggttttagcctccgaccaaccactctcttacatatccacaaagagctctttcacgatatttttgacagcagtattccagtagttgaataccgcactgtcaatattacaaaaaatgaattagtcttaaaaggtgatacagtgatttattcagattttcccttgattgccgccactttggactatgatttccagcaagaaagggatttttcttatgctaggttagataaaaaagccatcgtcgctcatatccaatcctttatttcaggtgtttggcaaatccacccattccgtgaagggaatactcgaacaatcaccgtatttctcatcaaataccttcgctcacttggttttgagattgataatgagccttttcaaaaacatgcaaaatatttccgtgatgcgcttgtacttgacaatgctaagttagtcaataaacgctcagattttttaactgccttttttgaaaatctcctcttgaacggtcagaatgatttatcaagtgagaggatgtacgaggagttggggttagatgaatatcaataaagacaggatagttttcaagtcggaaatagaccagtgaatacttgggcttttgacttttcgttgataatctcgttaggcaatttggagaaatcgtatgtcctattattatgaaaaattaacgggtaaggttgcaaagcatcttgctcgttttccctattatgctaccgataagattctgaatttaatgcaatttcaagataacaatcagcaatttctgataagtgataagcatttgtatgattactttgaagaacaaaaacatcaactaagtaccgatgaaaaactctccattctgttcaacctatttaagggacgtatagatgtttatgcgaaatcttatattgatgaaaatggaaaaatcaactattttccttcttacaactatggttggaaaaaacgtcctgttgaaaagagaacttgtcaaccattgaccaaacaggtattattggctcacctacgtggcgaaatcagtattggtatttttccaatgagtttatcagacacgtgttcctttttggcgattgattttgataaaaataattggagagaagaggtctccattctaagagatacagcagaacaacatggttttgaggggcatatcgaaatctctcgttcgggcaatggtgctcatctctggtttttcttcgaggaagaaattgcttgtcagcaggcgagaaatgttggaaaaagactgctggaattggctatgcaggagtcaaaagatattcgcttttcttcatttgaccgtatgtttccaaatcaagatattctgcccaagggaggatttggcaatcttatcgcactgcccttacaaggggaagctttcaagaagggaagaaccgtttttgttgataaacattttcagcccttttctgaacaatggacctatcttcaacaggttcaaaagattggacagaagaaaattctagatttcttaggacaggagttttcggatactgtagatgatacagtattagattgtagcttatcaaacgttattcgagttgagaagagggctatttcttcaaaaacaaattacttattgagaaagctggcatcttttcctaaccctgaattttatctaaaacaagcgaccagacaaccaacctatcagactccagaacgcatctatttatttgaagaaacaaacgaagccttgcatcttccaagaggaatacttgctaagctacaggaaatctttgaaacggtaactattagggacaatcgcaacagtttatctccgattcagatttctttcaaagggaggttgcgttttgagcaggaacttgctttggcagatttattagctagtgagaatggcttgctatgtgctgaaacaggtttcgggaagacagttttaggggcagccttgattgcccagaggaaatgtagaacgattatcttagttcacaatcgtcaactgttggagcagtggttggaaaggttgggtgaatttttagagattgaagaggaagaggcagttcgctatactccttcagggcgtgtaaaagtaatagggcatattgggcaatatggggcttctaaaaaatggaggagtaaattggtggatgtggttatgattcaatccctcttccaattggacgtgatttccgactttttgtcggactacgatatgatgattgtagatgaatgccatcatgtgacagccttgcagtttgaaaaagtagttgctcaatttgctagtcaatatctatatggcctaacagcaacgccagagtgtaaaaatggacatcaaccgattgtctttcagcgtattggtccaattttacatactgctcaatcaggtcaatacgattttaaaaagaggttactactccatctaacatcttttgggaaattggacttggaacagtcgaatagtacgaactttgcatcccttaatgattggcttgccaaagatttacatcgtaatactttgatcgtgcaagatattttcaaactatatcaagaaaaacgaaacatccttgtcttagtcaatcgacgggaacatatagaattattggaaaagctacttattgaaaaagaaatgcccaatattttttgtctgagtggagcgagtaaaagaagagatacgaaagaactcctgaaaagaatcagtgagctagatgagaatagtccatttgttctcatttcaacaggaaaatttattggagagggcttcgatatgccaaagttggatacattaattttggccgctcctttgtcttggaaaaataatctcatacagtatgcaggacggcttcaccgtccctatcaaggcaaaactgaggtgagaatagttgactatcttgatatacacgttccctatcttgaaagaatgtaccagaaacgtcagatagcctatcgtaaaatggcctatcaggttggagagaaagaacaaacccaagtattattcagtggtagggactacgaggagaaatttagagaggatttgcggaacacacgttcaacagtctatttacaattgcattcgttcacttctagtaggattcaagaattattgggactgctccgaggaaaacaagtagttattcatgtttccaaaaatcataagttaagtgagtggctaatggggttaaacagtgacaatgtaaaggtgaagcttgtaccagaaaggattggtacgaccgcagttatcttagatagtaatctcgtttggtatggcaatttatcccccttcacatatcagtcggatgaccaagctagtttgttgagattggaaagtcaatctattgcaactgagttgcttgaaaaatttgagaattcaaatattaaataaaaaaatccgaatactgttctgttcggatatttctttaaaaaaagaactgtatttgtattaaaatttaatattttgtataaaaaatatgataaaataatgagaaatggaggtgcatatggaaaaagaagtgtttactcccgatcaaagtcaatctattgtagatgctatattgaagggatacaagtcctatcttgatgagcgaattgaaaagagaagaacaatgcatgtttctgctggttatgtttggactaaagctaatcatatagatggtgctcttgcgactgcaaacctaaattttattgataaatttgagttgaaacatgcgagtcaatcttgggagtttttagaatttaactcagaaaatcaactattaggacgtgtatgttttgttttaaaaggtcttactcgcttgcggcaggtttttccaacagcagtaaaaagtggaaagggctatttatttgactatgctcaaattaatacaagttacctagaaaatctttcaaggcataccgatgaaagtacgcttttccctgttcagatggaattgtttgatgacaatttatttgaacttttgaatcggtctgaacaatctatcaataactttttctttatcacatatcaggctgatgaattacatcacttgacgaatattcaagttatcatgcctgattcaagaactgggaaattgattgaaattcaaaatttatcaacatttatttctacaagtaatgtcgattttaacgatgaaaaatatcaagagttacaaggcttatcagagattgatgatgtagctgattttgagattataccacgtcttgcttcagaaaaagaagcttagaaaggcaaaaaaatgttcaatggttcaagactggaagaattacgacttctgaatggccttacacgtgcagatttggcaagagagcttgaagtgaccgaacaggctatatggcaatttgaaactggagttacacttccaaaaatgaaaaataagatagcaatggctcgtttttttcaggttgaagttgactattttgatgctgttgataagaatggttcattctcactaagtcgcattgcctttcggaatgcagaccttgaggcaaaaaaaaacatccatatccaaatggtatatttggaaaaaatgaatcaaatgatagattatttggagaactttgtatccattcctaatcaaataatttaccagttagttgatagtattgagcaaaaacttcagcaacatgaatcacttgagtttattgctgatcatgttagagaggtattggcagtatcagttgataatgccaatctcctctatagtttagaaaaatctgggatatacatttcagagagattaatcaatggaaatgcggatgcctatagtgcttggtcacgtaatggtcgaccttttatcgttttgggactgggaaaatcagcggtacgacataattttgatttagcacatgaactagggcatctactcttgcacaaccaagtagattttgaggaactgtcaaaagaagaattagaggaaaaagagaaagaagccaatcaattcgcctcctatttcctgttacctaggaaacaatttttaatggattttgtgaatattgtaggtaagcgtgtcagcaatcctgatcaatatatcttgttaaaaaaacgttttggtgtctcaattcaagcgcttgaatatagagcctacaagcttggcttactgactccacagcaaaattcttatttctatcggcagatttcaaaaaaaggatataaagcagttgagccactagatttggaaattcccttaaagaaaccaagtaaaatcagaagtatcttagatgtcatcctttcaaacaatcttttaactctgtcagatattgaacgaaatcagagggtgtcaaagaattttatcagtcaattattttcatttgatgtgaaattttttgataagtatttgcttcaattagatacgtttgataatgtaattccattgttttctagaaaacaatgatggggagtagagtaatgaacaaaatcaattcttacaaaatccacctcccctctctcctccctttcggtttccttttcgccaacaattgttacacctaccgagaggtgtttatggaggggcagtttgaggcggtggtggaggttgatgaggctggtcagctgtcgtcctatgtttgggattgtgagatggaggaggtctataccgcccatctggtgactgcgccatctggggcttttgtggggcaggtgagagaaagctatcagtccattttggatcgagtagaggaggcctgctgtatcgctctaccatttaccaaagaccaaagcaaccgcatagcccagctcattaaggagcagtggggcgaccttcctgactatccctttgccaagttgccgacctatggggcttttcgccaccccaacaataacaagtggtacgccctggtcagtcagattccgagggacaagctggatgggagcggttctcaagaagaggtggagattgtcaatctcaaggttgccggtcgggaaatagcagagctgttgagtcggtcgggcatcttccctgcctaccatatgtcgaagaagacctgggtgtcagtcttgctggatgatacggtggaggatcagacggtgtttgctctccttgagaagagccgttatctggtaggaccaaaatcctacaaggcgacgcaagggcctgattactgggttattccagccaatcccaaggtctatgatatcgataccgaatttgcagaaaataaggtagtctattggccacaaaaatcaaccattcaagtcggggacatcgttgccatttatgtcacggcacctgtacaggctattcgctatgtttgtcgagtcttgggggaaaacttggaaaatcatggagagtcagatattccaacagaaaagaaactcatgcaggtggaattgcttgctcagttttccgatgatgttttgccgagagcgcgcatgatggacctaggagtgaaagctgtccgtggacctagacgcctcacaaaggagttgatagacgttctgacatcagaagtgataaatatttattaaattatcagaatatttaataaaaatctttacatctgcaaaaaaagcggtataataagactattaaaatttaaggaggagtaggtatgaagaaaagcttcattcatcagcaagaggagatttcttttgtcaaaaatacatttacccagtatttaaaagataagctagaaatcgtagaagtgcaaggaccgatcttgagtcgtgtcggggatggtatgcaggataatttgtccggtgtggagaatgcagttaccgttaatgtgaagctgataccagatgctacttatgaagtggttcattcgcttgcaaaatggaagcgtcataccttggctcgctttggatttcacgaaggagaaggtctttttgtacatatgaaagccttgcgtccagatgaggattccttggatccgattcactcggtgtatgtggatcagtgggactgggaaaaggtcatccctgatggtcgtcggaatttagcttacttgaaagaaacagtagagcagatttacaaggctatccgtctgaccgaattggccgttgaagctcgttatgacattgagtctgttttaccaaagaaaatcacctttattcacacagaggacttggtgaagaacttcccagacttgacaccaaaagagcgtgaaaatgtggttgccaaagaatacggtgcggttttcctaatcggtattggtggagaactggcagatgggaaaccacatgatggacgtgcaccagactatgatgactggacaagcccatcagaagcaggctacaaaggactcaatggagacatcttggtttggaacgaagcacttggatcagcctttgagttgtcctcaatggggattcgtgtggatgaagaagcgctgaagcgccaggttgctattacaggtgacgaggaccgtttggaatttgattggcatcgtgctcttttgaatggtctcttcccgctttcaatcggtggcggtatcggtcaatcccgtctggccatgttcttgcttcgtaagaaacatattggtgaagtgcagtcgagtgtttggccacaagaagtgcgcgataattttgagaatattttataagagattggcttcaatctcttttcttctgctttcaatctgctatctgaaaacatttacaacaagattatctgtgatttttgcgccaatctatgatatacttttttagttaaattaaaatatatagaggatattatgacaaaacttagagaagacatccgtaacgttgccattattgcccacgttgaccacggaaaaacaaccctcgttgatgaattattgaaacaatcccaaacacttgatgaacgtacgcagttggatgagcgtgccatggactcaaatgacattgaaaaagagcgtggaatcactatccttgctaaaaacactgccgtagcttataacggtactcgtatcaacatcatggacacaccaggacacgcggacttcggtggtgaggttgagcgtatcatgaaaatggttgatggtgttgtgcttgtcgtggatgcttacgaaggaactatgccacagactcgtttcgtattgaaaaaagcccttgagcaaaacttgactccaatcgtcgttgtcaacaagattgacaagccatctgctcgtccagaagaagtagtggatgaagtgcttgagctcttcatcgaattgggtgcagatgatgaccagttggaattccctgttgtttacgcgtcagctatcaacggtacttcatctttgtctgacaatccagcagaccaagaagaaacaatggcaccaattttcgataccatcatcgagcatatccctgcaccagtggataactcagatgagcctttgcagttccaagtatcgcttttggactacaatgacttcgtaggtcgtatcggtatcggtcgtgtcttccgtggtactgttaaagttggtgaccaagttaccctttctaaactagatggcacaacgaaaaatttccgcgttacaaaactctttggtttcttcggtcttgagcgtaaagaaatccaagaagcaaaagctggtgatttgattgctgtttctggtatggaagacatcttcgttggtgaaactgtgactccgacagatgcagttgaggcacttccagttcttcgtatcgatgagccaactcttcaaatgactttcttggtgaacaactcaccgtttgcaggtcgtgaaggtaaatgggtgacatctcgcaagattgaagagcgccttttggccgagttgcaaacagacgtttctctccgtgttgaccctactgactctccagataaatggactgtttcaggtcgtggtgaattgcacttgtctatcttgattgaaaccatgcgtcgtgaaggctatgagcttcaagtatcacgtccagaagttatcatcaaggaaattgacggcgtgaaaatggagccattcgagcgcgtgcaaatcgatactccagaagaataccaaggttctgttatccaatccctatctgagcgtaagggtgatatgttggatatggttgcgacaggtaatggtcaaactcgtcttgttttccttgtgcctgcgcgtggtttgattggttattcaacagaattcctttcaatgactcgtggttacggtatcatgaaccatactttcgaccaatacttgccagttgttcaaggtgagatcggtggtcgtcaccgtggtgcccttgtttctatcgaccaaggtaaggcaacgacatactctatcatgcgtattgaagagcgtggtaccatctttgtaaacccaggtactgaagtgtacgaaggaatgattatcggtgaaaactcgcgtgaaaatgacttgacagttaacatcacaactgcaaaacaaatgaccaacgttcgttcagctaccaaagaccaaacgtctgtaattaagacaccacgtatcttgactcttgaagaatcactagaattcttgaacgatgatgaatacatggaagtaacgccagaatctatccgtcttcgtaagcaaatcttgaacaaggcagagcgtgataaggctgcgaagaagaaaaaattagcgactgaggaataatttctaggagaagaagcatgttttatttaatcctcgccatcatgttagtacttttttatatttttattgcacctagcaatattaaggggactatgaatttgattgcggcagtatttttactggtagcattagcgattgccttggtacttggatttttaagaatcatgcaatttccaaaggaaatttgggttggtctactaatgattctgattggtttttgggcgatgcgggatatttatcaattaaatgacgatacaaaattttagcagagtctttgatttttgaataccgtaatacgatattactaaggaattttatccagctttttggacagtagtggcaatctattagctaaagaaattatattctgtgatacatcttgaagaagctctcgttatttataataaatgacaagcgcattttcaaggtgtttttatgtagataaattttaatactcaatgaaatccccaaaatagcaagtttttagtacagtcatttaaattaactctgatacatcgccgctttcagcttgccgcactctacgaaagtgactcgtttcgcatgtcttatttccaacctagaacagcctctaggctgttctagctacctgcacatcggttccttgtctgaaagctaattcattagaccatacaaggcaatgagctgccgccgccaacttttatcaacatcttagcaatttgcgttttacagtctgaagctgatctctataattgacgggagtgggaaagacatccatacattaaagtaattaaagacaaattaaataactatattagtcattcaaacctaaatgagagggaattgttttataaaatattgctaacagttttcccttagacaaactcatattactagacaataaatggaaactatagtaaaataccaagtattgttattaagttgtactttaacttagttgtataatattttggtaaaagagaggaaacgcagatggatgtaaaaaatcttcggaaattaaagcgaattgagttatatgagattatgttggctcaaagtgaagagattgattgcttgagaaatcaacttgagaagattaaaacagagttggctgatagaagaattatgattagtcaatctggctccatagcggaagcttcaatgaaactgactaatatttttgaagaagcgcaaaaagctgcggatctatatctctataatgtgaaaaacaaaattggtgatgttcatgaatagttcaaatctcaagggaaaggaacttccaaaaacttcagaattaaaagagctatatcagcatgaaagatatagacatacattttggaggacagtgaaaagtacagtgtttatgttggtagtagttgcagcatttgcaatactaatcgctgtattatttttgcctattttgagaatatacggagattcaatgaaaggaaccctgaatagtggggacatcgttgtatcagtaaagagcaatgattttgaaagcagtgatgttgttgctttttattacaataacaatattctggtcaagcgcgtcatcgctgaagctggggattgggtggatatggataaacaaggaaatgtttatgtcaataatcaaagattggacgagccatatttggcaaatagggattatggtcatacagatattgagtttccctatcaggtaccggaaaatcgaatctttgtcatgggagataaccggaaagagtccattgattcgcgaaacaacgctattggtacagtctctaatgaacagattgttggaaagttggtatttaagatttggccactgtctgaattgggatggattgaataaatgaaagtgaaaaaatagaaaggaggatcttgtgagagactggttaaatttagaaaaaatccaaggttggcgacgaaagtacaagaagctcgtgaatatcattgctttcctcgtagtatttgcaacgacctatgctttgattctacccgctatcacattagaccaagaaaaggctgaataaactgctgggattgaagtgcaagaaacaccagtaacaacggaaattagtaaattaacagaaccgatggtgacaactcagcaaactccgatagtgggtagctctgctgatgaagttcaatctcctgcgacagaaacggttcctgaccctgctgagcaagtgtcaacagagtctgctagcaaaccccagaccgaccaagaacggattactgagccaactaccatagttcacaaaacgaatgattatgaggtgactgcaacatttgatgcgagtgctcaatttcccaaagatgttgagtttaatgttagagaactagatagccaatcagaagaatatcggacacattatgaaaaaaccaaggagaagcttggagtaaaaaaacttgtatatgcccgattctttgatattcatttttcatcacagggccaagaggtcgagcctgcctcccctgtgaagattacgattagaaacaaggaattagttcaacggccagatgatagtaaactgaaaattgtccactttgaagagaatagccagatagaagttttagaggccgaaacgaaggaaaatgaacaacaaatctccgagatcagttttgacgctagccatttttctgtttatggagatgttttagcaaactattatactgtcaaatttacctacactgacacagcaggtcaagaacaagtcattacgagtttgattgataagactgtggggacttcacttggtagtttgcctgaagctccttttaaaaacggttatgtattttctcattggattaataaagatactggtgatcggattgatgaaaatacggtgataactggcgacctgactgctgtagcagtatttaataatatcaatatctacaccattgatgtcacgtatttctaccacaatgtttctaaaaaccaagatattacgattgataaggaaacggtgcaactggaagcaagtgatgctccatatcaactgacaccacctgcttctactgaggtgagcaacaaagaggatacaactttaccagcagatgctatttactaccctgaaaaaccacttcttgagtttacagcagatcaactagagcgactggacgtagcagatggagtggatgataattatattagcgaaagagtacaatatgttccttacaatgcagagtatgatgtcatttataggctaaagaatttgacggggtcaggttattctgatatccagactgttcatgtccgtggggtactgggttcaactgttacaccgcaaattctaacctacaactatgctgactttgaacgtgctgatacagcaaagattgagaatactagcggccaaaaattgtatgtttattatacacggaaaacctttactctttcttataattccaatggcggtagtaatattccccaacaacagggtctatacgatagccagattaagatttctacaactactccaacaaaagaggggtatacatttgaaggttggtatgataatcctggactgactggaaacaagattacaggctctctcaccttaaagaaagatacaactttgtatgcgaaatggacaccgaacagggttcgctacatcattgggtattacaaggaagtctatgacaacaacactggaacaacctcctatgtatatgatagttcggcagctggttggggtctggttgggactactgtaaaaggaacagattcaaatattggacctcctccgccaacccaaacaaccattggcagcattggctacgagaaggatgttactaaaagtgctgcttcaagtattgaaattgcagctgatggaacatctgttttgaaagtttactataaactgaagcgctacacttttgaatttttcttaaatgataacaatgccaatatcaccataaatggtaagacctactctgataggaataggtacatgatacgtgatgttgtgcttggtcaagatgtctcaaagttatggccagcttctataacaaatcctaaagaagtatacgatgataaagtctactatgatagctatggtaggccgataagatacttttttgactactggatttttgggaatctactcttcaaaacagatcggttcgaagttgttgagtctatgttgccaacgagtggaacaaccagtaagttcacagcatattggaatacccaaggtacacaggctaacgttgaatattggttacaacaaccggatggttcttataagaagtctgatatatatagtcaatctttcctaaagactgcaggactgctaccgaaagaaatttttggatattcttattatacagatgctagttttactgaagcaggcattaggtattacggaactcaaggaaatacatatcgtttctactataaacgccaagccttcaaaattgactattattacaatagtactgggttagattcaaagagtaacattctctttgagagtaacatcaatacagcaacttataattaccaaccaccacgttctactggagttgatgctgattatacatggggtggatggtatacagattcgttattgacagagaagtataactttaataagatgcctgccaataacttggttctctatgctaagtggattgctccaaaatttaaggttacttttgatatcaacggtggtaatggaactgcccctgtcgatcaaagtgttgaaaaatacaaatacgctaaggcccctgctgatccaacgagggaacattacaatttccttggttggtctacagaagatgggaaactctatagttggagcgaccaagtaaccaaggatgtcaaattgactgcgaagtgggaattgaaaccattaacttatactgttcgctatcttgaagcaggtacaaatacgcaattggctgctgataaagtgattacgagtccagcgcttgtattgaatcaagctatcacagaaaaggcattgggaattacaggttatcgaccagataagagtagtcaaacaattaacctgaattttagagggaacgaaataactttctactatacaccgaaggtaaaagatgttgtttacaccatcaagtatgtcttgaaggataacccagctattgaggtagcacctacagttactcgtaaggttgatggaagtatcatccgtgcgaaagaagctgctgcagatgtgaataaacagcatttgcagagtcagtctggtgttactgctgaaatgctggaaatggattactatccaactgtaaatactcaaagtttgattctaacttctagtgatgcaaataatgtgattgtttttgaatatgtcggattcgatactcaaacctttacggtaaattatttggatatggatggtaagaaaatcgatggtcaagaaccattggtagtttaccgaaagaaaccaggtagtttcgtggtagatcataagactataaatggttatacctatgatcattcgttagacagtgagaatgcagctgataagacagtataccgtgtaagtaagggtggtcacataaccattgatctctattataagaaaaacctaacactgaccgcattagataagtccaaagtttatgatggcactgccctatcaagttcgggtctgtctgatttaaatccttcgtacagttcagaactgaaaacaggtgacaaattggttgccatcagctatgatggaagtcaaacaaatgctggtagtagcgcaacgacacctaaacttgctaacatcagcaatgcatctggtgctgaccggacgaatttctatcacataacctatcaaccgggtaacttaagagttgaccaacagccagttgtggttgtcatcgacggtgaaaagaaatcgaaaatctatgatggcaaagcagaagcagttggttataaggtgacggaaataagagattcaagcggtctctataaaaaaacagatatcaaatttaatggttcaagttcagagcagtcggttaagaaaaaagatgcaggaatttatccactccttttaagtaatagattctcaaataccaatcagaatttccaagtagatttcttgatttctgatggggaattaagaatagatagacggcaactgaccataacatctgactccgctagcaaggcttatgacggtagcgagcttcgtgctgacaatatcacagtctctgtacctgctggtgttgactacacaggttttgtcgatggcgaagggattataccaaccttcttaggcggtccaatcgattctggaatgatgccaaacttctttgaatatgctctaaaatctggcacgaatttagctaattatgagttagatatccagtttggccagctcaaggtcaaagaagtcatcaagattcagaaaacagacctggcctggcaggccctttcaggtggtaagtttgaattgaccaagtgggatggtttgaactgggctcaggtagatggggtgcaggaatttgccattaccagcaaagatggtattcggataccggtaggcttagaagcaggtcgctaccgtctgcaagaattggcagcacctgatggttttatcgtcttggatagctatatctacttcagcatcaaggaaatctttaacgaagataagacatcttccttctacacagtttccttgtctgatgaagcaggcaaggatgctagtccggaacgagcaacgcttaccaaggttagtggtgatgccagtcatcgcatccaagtggccaatgagcagggcagagccttgccaagcacaggcggagatggacagaagtggtttattctttctggccttgtcctcatagccatctcctatctgatgcatctgtttgttcaacgtcgaaggtaaaggagacagtaacaatctccaaatcccttagtagtaaatcgtctcagctttctaagtaacgtccagtttcttagacctaatccaaataaataaaagaaggaatattatgaaaaaattacaacaattctttacatcccttgtggcagtactgacagtcttcgcttttggttccacggccttggcgcaaactgttgatagcggaaaaagtggagcaggcactattactgtctctaacgcttcacaaggtcaaacttacactgcctataaactctttgatgcaactgtaaccacagatggttctggtatctcatacaaacttcctgctggtaaaattgcaacgaactttggtggtgatacttggttcgaagtggacagcaaaggtaatattactgcaaaggaaggtgctactgtctcttcagaagcatttgcggcttgggcaaagaatttcggtacagaagttacaagtgctacagcgaatgataactctcttgtgtttacacatttgacatttggttactattttgtaacatcatcacttggtgcagtgcttacagtagatagtacaacaccaaatgcaactgttatcgataaaaacactactaatccaaccattccagattcaaataatggtggcggtaagaaaattcttagcaatggtgctacaactagtgaaacaactgcaaaaattggcgataccatcaacttccaaatcaagtttaatgctaccaactacgttactaaagatagacaaaccaagcagattgtttcttacactatcgaagatagcccaacagccctcgcaattgatcaaaattctgtcaacgttaaagtggatggtgtggatatcacagcaaaaatttcgaagacttttgatgcaacaggcaaaatgaatcttgtcattacatgggcggatgcggcagctagtaataaaaccatctataactctccagctgaagttattatcacctactcagcagtggtgactaaagatgccaaggagggagaagcaaccaactcagcgactattggttacaacacaattgataatccaacaactcctccaacaccagttgatccagacaagccaactgaaacaacaaaagtgactactcaccgtttcactttgaaaaaaacaaacaatgtaggtgaaactttgacaggtgcagagttcaaactctatgatgcagccaacaatggaactgaaatcaaggttgtcaaggaatctgacggagtgtatcgtgttgcgcaggctgatgagcaaggtgttgtcatcgaagctggcgaagttgtgattaaaggtctgaaacatagcacgacctattatcttgaagaaatgaaagcaccgaatggttacaatatcttgacagaacgtcaatccattgaagtgaaagagaataacacagcacaagcaaatatcgtcaataaaaagggtggtgtcttgccaagcactggtgcgattggaacaactttattctatctagttggttcaatcctacttttggtagcattggtttatactatttcaaaacgtcgtatgaacaatatctaattgtccatacaatacctaatatttagaatctatcttcggaagtgcaaaagcaagagtggaagtatttccgaagatatttctttggtcttaacacaaggaaaggaggggatttcatgatcaaatggctcaaaaagaaaggtccgtcttttatcatgccattaatttttatattggggattggactattggcttatccatcggtcagtgattactggaattccttccaccaatcagaggccatcatgtcctattctgacacagtatcagatatgacagctgaccaatacaaagaaatcattgatagtgcgcgccagtataatcaagaaaaacccttaaactggaatgtgactgcatccgacattgaagcctacaatcaggaattgaatttcaataaagatggcatcatgggctatattgagattcctaaaattgatgtcaagttatctatatttcatgggacagacgaaacggttttagagacttctattggacatctagaaggaacatcgttgcctgtaggaggtttgggaactcatagtgtactttcagggcatcgtgggctcccatctgcccgtctgttttctgatttagataagttgagagaaggcgatatatttaccattcacgttctcaatgaaacactaacttacaaagtggaccagattcgagtggttgagccatcagatttatcggctcttaccatggaacctcagaaagacttattgactttggtaacctgtacaccctacggtattaatacacataggctattagttcgtggctatcgtattgaaaatgttaatggtagtgctttggttacctctgatgctatccaaattaaagcaatttttattgctccatttatcgcaactccaattctatttgtaatcttaatttatatttttataacaactagtaaaacatttcgttctcggaataggaatcaagtgttggatgattttttagttcccaagaaattttgaactattgaaaatgtttcaaagtcgatttgactctggaacatttttctattatagacattagacaatatggctgaatgaggtaattgttcaacttctaacctcctgtcaactcaaatcaattgcctagaccgacgattgaaacgacttctttctagtaactgaccgcaagggaagaggtggcagatggtgtagaaatggcgctgtgatgtcatacctagttcagcttgtaacaaaagtaagacaaggattgattcatctgaaactttaactaagccaacatttcgccgatatttgaaggaatccgggcaatagttgttgtagaagtgatgacaaatttgtgataattggcgtacattccattgcaaatgatgagatttagcagtatactgtaagtagctcatttggactacccctctgtatgtttcgtcgcttacagtatagtccatttgggctttttattgtattttgaaatgaactagcgctacgggcagagtttacttttctgtcctctggcttgaaaaaggtcttcgtaaagggtaaaataaggtgttagaaagtaaaggtatttgagatgaagatgattgatattgtaaaaaataagaaagtgttagtgctaggtttagctaaatcaggggaatctgcagcccgtctactagataaattgggtgctatcgtcactgttaacgatggaaagccttttgaagaaaatccgactgctcaatctttgttggaagatggtatccgtgttatttgcgggagccatcccttggaattattggatgaagatttcgctttgatggtaaaaaatccaggaattcgctatgataatcctatggttgaaaaagcaattggcaaaggaattccagtatggacagaggttgaattggcctacttggtatcagatgttccaatcgtggggataacaggttcgaatggcaagacaacgacaacgaccatgattgcagaagtcttgaatgcaggaaaaaaacctgcaaaattatgtggaaatattggctatccagcatcttcggtcgctcaaactgcgactgcagaggataccttggtgatggaattatcgtctttccagttaatggggacagaatctttccatccgcatatcgccgttgtgaccaacctcattgccagtcatattgattatcacgggacttttgaagactacgtagcagctaaatggatgattcagcgtcagatgacggctgaggattttgtggtgatcaacttcaaccagaaagaggctaaggaattggctggacagaccaaggcaacggttgttccattttcaacacaggaagtagttgatggagcttatttggcagatggaaaactctatttcaagggtgaatacatcatggatgctgaccaaattggtgttccaggttcacacaatgttgaaaatgccttggcaacaattgtggttgcaaaattgttgggagtagatcagcaagcgattcaggaaagtttgtctgcctttggaggtgtcaaacaccgcttgcaatttgtaggtgaaatcaacggggtttccttctacaatgatagtaagtctaccaatatcttggcgactcaaaaagctctttcagggtttgacaatagcaaggtcattttgattgcagggggcttggaccgtggcaatgaatttgatgaattagtacctgatttggtcggactaaagaaaatggtgatccttggtcaatcagctccccgtgttcaacgtgctgcagataaggcagaagtggaaacgatagaagctctcgatattgcggatgcgactagaaaagcctttgccattgcggaaaaaggagatattgtccttttaagtccagccaatgcaagctgggatatgtatgccaattttgaagtgcgtggcgacgtcttcttacagacctttgaggagttgaaataatcatgaaaaaaattgtttttacaggcggagggactgttgggcacgtgacgctcaatctccttttgattccgcgatttttggaagaaggctgggaagtccactatattggtgatgggaacggtattgagcatgagcaggttgtgaaatcaggtttagatgttcatttccattcgattgcgaccgggaaattgcgccgttatttctcttttcaaaatatgttggacgtgtttaaagttggttttggtgttcttcaatccttgaccattattgctaaaattcgtccgcaagctcttttttcaaaaggtgggtttgtatcggttccgccagttattgctgctaatttgctgcgggttccggtctttatccatgaatcagacttaacaatgggactggccaataaaatagcctataaatttgcgactaccatgtatagtacttttgagcaacctgccagcttgactaaagtaaaacatgttggtgcggttacaaaagtggggcaaacgaatgacaaagttacaccaattcagttgccagaaattctcagtcacttcgataaaagtctgccgaccctactgtttgtaggtggttcgggcggtgctaaggtctttaatgatttaatcagtcagaatagtgctgccctgaccgaacgattcaatattatcaacttgacgggggacagtagtctcaacaaattagataaaaacctatatagagttgactatgtaacagaactttatcaaccgttgatggatttagcggatgtcgttattacccgtggtggttccaatactctgtttgagttgattgccatgcaacaactccatttgattgtgcctctaggacgacaggccagtcgaggagatcagattgaaaatgctctctatgcagagaaaaagggatattctaagcagattgatgaaagtcaattgacatttgccagcctgttagtagaagtcgatgagctattgaaacataaggaattttatgtccaaaacatggcaaattctaatgaaattcagtcagtagatagtttttacaatttgcttagagaagatatgggaaggtaggttctatgacggaaaaagattcaaatgtagaagaatcagtgctagaagtggaacaggcatcccaagtagaattggattccgaacaaatttcaccagcagagaaagaatctgtattagccgaagagaaagaattttctacggatgtagacatacctgagatgactgctccggatgatgaaaaaagtgcctttttcgaacaatggaaagcacgccaccaagcctaccttgctcataaagatgaggcagatattcaggcagttgacgagggacagacagaacaggagatcccagaagctaaaaagagtaaaagggtcctttttcagggaatagaaagaaaaacagagagtctgaaatctaaaaaggaaacaggggaaaaggttcaaactttaaaagttgatattccttccaaagtagtctggaaagctattccggttcttgtgacgagtttgttactggcagctctagccttgtattttatttctccaaccagcaagaaaaaacaaatagaggttgtcggaaatgagcgactaactgctgagcaagtagaaaattatagccttatctctccggatgattacaatgtgactatagctttgcatgcagatgcttacgcaaagaatattaagaagaatagttcgtccgttgagacagcgacaatcaagttccagtttccagctacctttaccattcacatcaaagaatacgcaataataggctacattcagcaacaaagtcagtggtatccagtattgtctagtggagagattggcggtgaaccgatttcacaggattccttgccagaagactatacaacaatcaatttatccgacaaggaattaatcaaggaactggccattgaattgggtaaaatagatgcaggaattcgttctgctattcagacaataaatttaacgccaagtaaagtgaccgcggatttgctgacattcaatatgagagatggaaatactgtattagtcccgttgagtgagattagccagaaggtgtcctactatacaaaaatagcagcagaagtgactgttccaacaacaattgatatggaagttggtatttatagatatgcaagctgaaatagataattttgtaaagaaaaagtaataaaaaaatcctttaaaaacaccataattcgatataatatggtataatgaatgatgactaattatactatttttcaaaatggaagatgatttgttaaagttggaagtaagagaggactgatagaatggctagaaacggcttttttacgggattagatattggtacaagctccgttaaagtcttggttgcagaatatattgataacgaaatgaatgtgattggggtcagcaatgtaaaaagtgctggcgtcaaagatggaattattgtaaatattgaggtggctgctggagcgattaaaaaagcgatcgagcaggcagaagaaaagtcaggtatccgcattgaaaaggtaaatgttggattacctgccaaccttcttcagattgaaccgactcaagggatgattcctgttacaacagattcacaagaaattacagacttggatgttgagaatgttgtaaaatcagcattgacaaagagtatgactccggaacgcgaagtgatttcatttattccagaagagttcactgtcgatggattccaaggcattaaggaccctcgtggaatgatgggaattcgcttggaaatgcgtggtatgctgtatacaggcccacgtaccattcttcacaatcttcgtaaaacggtggagcgtgcaggtgtccaagttgaaaatattgtaatttctccgttggcactaactcgctctgtattgaatgaaggtgaacgtgagtttggtgcgactgtcattgatcttggtggcggtcaaacgactgtggctgttatgcgtggccaagagttgcaatatacaaacatctaccaagaaggtggagattatatcacaaacgatatttcaaaagtattgacaacttcaaagagtattgctgaaaacttgaaatacaactacggcattgcctatccgcaagatgcaagtgataaggaaaaatttactgtcgaagtgattggagaaaacgctccagttgaagtgaccgagcgctacctttcagaagtgattgcggcacgtctgcgtcagatttttgaccgtgtgaaacaagatttggagcgtacacgtgctctagatttaccaggaggcattgttcttgtaggtggtggtgctatcttaccaggaattatagaattggcccaagaagtgtttggtgttaacactaagctttttgttccaaatcaaattggtatccgcaatccagcatttgcaagtgtgattagctttgttgagtatgttggtgagttagaagatgtagaaaatattgcccaacatgcagtaaatggtgaaactaccttgagacataagccagttgaaattcctgttgctcgtcctcggattagtcagccaattcaaagagaaatcgtgaacgaattgaacacagttgatcaggtagaggaacaagttgctcctacttaccatgatgaggaagaagaagttcgtccagctgctaagggaaacatcacagatcgcattcgtggtttatttggcagcatgtttgaataagagaaaagaaaaggtgatttaaactatggcattttcatttgaagcagcagctagtcatggtgctgtcattaaagtaatcggtgtcggcggtggtggcgggaacgcaatcaaccgtatgattgaagaaggtgttgctggggttgagtttattgcagcaaacacagatgtacaagcgctaagtagctctaaagctgaaacagttatccaactaggtcctaaattgactcgtggtttgggtgctggaggtcaacctgaggttggtcgtaaagctgctgaggaaagcgaagaagcattgactaatgtattaactggtgcagatatggtcttcatcactgctggtatgggcggtggctcagggactggtgcggctcctgttattgcacgtattgctaaaaacttgggtgcgttgactgtcgcagttgtgactcgtccgtttggttttgaaggaaataaacgtggaaactttgcgattgagggaattgaaggtcttcgcgaacaagtagatacacttttaattatttcaaacaacaaccttcttgaaattgttgataagaaaacaccgcttttagaagcactaagcgaagctgataatgttcttcgtcaaggtgttcaaggaattacagacttgattacaaatcctggtttgattaacttggactttgcagatgtgaagacagttatggaaaacaaaggaaacgccttgatgggtatcggtatcggtactggtgaggaccgagtgattgaggcggctcgtaaagcgatttattctcctcttcttgaaacaacaattgatggtgcagaggatgtcattgtcaatgttacaggtggctatgacatgactctgacagaagcagaagatgcttcagaaatcgttaatcaggctgcgggtcaaggtgttaacatttggttgggtacatctattgatgaaacaatgaaagatgagattcgtgtgaccgttgtggctacgggcgttcgtcaagatactgctgataaaccagcccgccatcgtacggaagctgtttcaccacgcccttctcaccgctttgatcattcagtagcatcagcaccaactcgtggagctgcacaacaaactgaagcgccgaaagcttctgccttcggagagtgggatttgcgtcgtgaaaacttgattcgtccaactgacacagaaccaacatccactgtttcagtcgaaaaatttacaatggatcaagatgaggatgaattggatacaccaccattcttccgtaatcgctaaactaaaatgaattttcaaaagaataaggatgctatcttttcagcagttgcaaaagctgctgagaaggcaggtcgtccaagtgaatcagtaaaggtaatagctgtcaccaaatatgttgacagctctattgctaatcagctagtgaatactggaattactcatattggagaaaatcgagtcgatcagttcttagaaaagtataatgccctagcagacaaacaattgacatggcatttgatagggactttacagagaagaaaggtcaaggacattattccatttgttgattatttccacgccctagactctgtcaaactagctcaggaaatagataaacgtgcgactaaaatagtcaagtgtttcctccaagtcaacgtttccggtgaggagagtaagcatggctttgcagtatctgagattgatgcggcacttgctgaaattagtttattggagaacattgaacttgttggattgatgacgatggcaccgattgatgctacagatgatgaattagacgagatcttttctaaaatgcaggaaatccaagaagaactagctacaaggaacttaccacgtatgccctttacagagttaagtatgggaatgagtggggactttgaacgcgccattgctcacggagctacatatgtgagaattggctcagcattctttgaataatggagaggaggaaaatatggcattaaaagatacatttaagaacttatttaattactttgaagttgacgaagtcaatgaagttgaagaacaggcagatgcctattcaatgcctaatgatcgtcctaaaatgcgtgttgccaatactacagttgcacctgtgcgcgaacagcagccaaaagtagagacgcgtcgggaagcacgttcagaaagtcaacttcaacgcctacatgaaaggcagcaagaattgatgactaataataacgaaaaagagattgtcaaaactacaattgatattaagtttccaaaacgttatgaagatgcaccagagatggtaaatcttttattagacaatgcgagtattctcattgattttcaatatatgtcggagcaacaagcaagacgttgcctagactacttggatggtgctcgttcagtattatctggaaatttgaaaaaggtctcaaataccatgtggctgttaactccagtaaatgtcacagtcaatattgaagaattgcgcaatgctggtacaactactggtgtggctgattcaaattttgaatttgatataaaacggtaacgctatgcaaattttgatttttttactattaaaaattgtagaaatttattcttatctcttattggcatacgctttgctaagttggtttcctagcctatacacaagctcgattggtcgtttgattcaatggctggtagcaccgattttaaaaccctttaggcggttaaatctgcagtttatggggttggattggaccgtaatggcagccatgattgcgcttaatatgggaacacgcttcttggttcaattattgctcctgttagcatagttatgaaaaatgacaaaaacttattgcaacatttttctagggaagaaagagagtttgtagagaaaataatggatatgtgtcagcaagttgaagatacgtattcatacagattaactcactttttacatcctagacaagatgaaattgtatgcaaaattgctaactactaccagttacaaacgttttctagtcgtgaccttgtttcgacagaacattcgcgggttattattgccccgacttattatgagttggacatcaaggactttgagttaaccgctcttcatttgtcctatgctagaaaatttcacaccttatcccattcacaagttcttggaacttttctcaatcaactagggattaaaagggagtatttgggtgatattttgattgatgatgaacgattgattgtctttatcgatcagaaatttgggcagattgccttacaatctatcactaaagttgctcgtgtccctgttaagggaaaggaagaagaatggacgactgttcgactaccgattggacaggaatggcgttcaaaggatgtgttggtttctagtatgagattggataaattgatttcggtcgcatttaatctttcaagggcaactgcaaacaagttgattgaggctggacatgtgaagttggattatgttctgacagaacaaaccagtaaattagttgaaatagggcaattaattagtgttaggagatatggtagagttcgcctaaatgaatttttaggtttttctaagcaagggaagataaaattaaagttagacattgttaaaacttaggaggaaagatggcacttacagcattagaattaaaagataaaacctttgctacaaaatttagaggatacgacgcagatgaagttgatgactttttggacattgtaacacgtgattatgaggatttaattcgtaaaaatcatgaccaagagttagaattgaaaaatttgcgagaacgtttggcttattttgatgagatgaaagaatcattgagtaaatcagttcttttagctcaagatacagctgagaaagtaaaggttgcggctgaagatcaagcggcaaatattattaaacaagctgactatgatgcggcaacattgttacatgaagctaaagataaggcaaatgaaattcttcgtaatgcgactgacaacgcgaaaaaagttgtcattgaaactgaagaattaaaaaaccagacacgtattttccatcagcgtctaaaatcaacagtagaaagccaattatcactggttaattcatctgaatgggaggaaatcctccgcccaacagcaagttacattcaaacaagtgacgaagcctttcgtgatgttcttcataaggctttggatgaagaattacctgttgaagaagaaagtttggattatacacgtcaattgacaccagaagagattgcagaattaactcgtcaggcagcagcttttgagagtggagaatctgtagtactttcaatagaagaataatagaaatcataagcaaagacaaggtcgttagaaatattttaagcgagtaggagatggtggaagccctacaatctctttctatggatcatcactttgtttgatctttcctgaaaatagtaaggagagacgtccgttcacgttacgaacatagagggatagaggaaactctatctaaactaaggtggtaccacgaactttcgtccttatttggcgggagttttttatttttatgatacgattagaattagtaaacaaggataactttgaagtagtgttacaagttcaacttgcatctgaggaccaacgccgagtggcatcggttgaatattctttagcccaagcttggttatataaagattcggggatgattctaccatatgctgtggtatctggcagaaaagttgttggttttgcaatgttatctattgaacccaaagataatagttattatttatggcgcttgttgattgataaggattttcaaaatcgtggatgcggaaaagaagccatccagcaaataattggaaaggcgaaggcggatccgctttgtcataaaatttcgataaattatgtcattggcaatcataaaatgcggtacattttagaaaaaattggttttcaatccgttggtttagaaggccaagaaatgaaaatggaattaattataaaataaaggagttatgatgaaactaaaagaaacactcaatttaggtaagacagcatttcctatgcgtgcaggcttaccaacacgtgagccagaatggcaaaaggcctgggatgaagcaaacttgtatgctcgtcgccaagaactcaatgaaggcaaaccagccttccacctccacgatggccctccatatgctaacggaaatatccacgttggacatgctttaaacaagatttctaaagatattatcgttcgctctaagtcaatgtctggtttccgtgctccatttgtaccgggttgggatacacacggccttcctattgagcaagtcttggcaaaacaaggtgtcaaacgcaaggaaatggacttggttgaataccttgaaatgtgtcgtgactacgcttttagccaggttgacaagcaacgtgatgattttaaacgcttgggtgtttctgcagactgggaaaatccatatatcactttgacaaaagactacgaagcagctcagatccgtgtcttcggtgctatggcagacaagggctatatctaccgcggtgctaagcctgtctactggtcatggtcatctgaatctgcccttgcagaagctgaaatcgaataccatgacattgactcaacatctctgtattatgccaataaggtcaaagatggcaaggggctcttggatacagacagctacatcgttgtctggacaaccactccatttacagtaacggcttctcgcggtttgacaatgggagcagacattgactatgtcttggttcaacctgctggctctgaccgtaagtatgtcttggcagaagccttggttgatagcttggcagccaaattcggttgggaatccttcgaagtgatttcaaaacacaagggtgctgaatttgaatatatcgtgaccgaacacccatgggatagagaagtggatgaattggtcatcttgggtgaccatgttacaacggactcaggtactggtatcgtccatacggctccaggctttggtgaggatgactacaatgtcggtgtcaaatatgacttggaggttgcggtaactgtcaacgaacgtggcttgatgaatgaagctgcgggtcctgattttgaagggcaattctatgacaaggttgtgccaacggttaaggaaaaattgggtgacttgcttcttgctagtgaagtgatcaatcactcctacccatttgactggagaaccaagaagccaatcatctggcgtgcagtgccacagtggtttgcctctgtttctaaattccgtcaggaaatcttggaccaaatcgaagcaacaactttcaatccatcttggggtaaaacgcgtctttacaacatgatccgtgaccgtggtgactgggttatctctcgtcagcgtgcttggggtgtgccgcttccaatcttctatgctgaagatggcacagctattatgaccaaggaagtaacagaccatgtagcagctctctttgaggaacatggttctatcatctggtggaaatctgatgcaaaagatcttttaccagctggtttcactcacccaggttcaccaaatggcgaatttaccaaagaaacagacatcatggacgtatggtttgactctggttcatcttggaatggtgtcatgaatgcccgtgaaaaccttgcctacccagctgatctctaccttgaaggttcagaccaataccgtggttggtttaactcatccttgattacctctgttgctgtaaatggtcatgcgccatataaagctatcttgtcacaaggttttgtccttgatggtaatgggatgaagatgtctaaatctctaggcaataccattctaccaagtgatgttgagaaacaatttggtgcagaaatcttacgtctgtgggtgacatccgttgatacttcaaacgatgtccgtgtgtctatggatattcttggacaggtttctgaaacctaccgtaaaatccgtaatacccttcgcttcttgattgccaacacttcggatttcaatcctgcaagtgatgcggtggcatacgaagagcttcgttctgttgaccagtatctcttggtgaaattcaataaattggtagttcaaatccgtgaagcctacgacaattatgatttcatgggcatctacaaatctgtagtaaactttgtaacccttgatttgtcagccttctacctcgattttgccaaagatgtcgtctacattgatggtgctaaatcactttctcgtcgtcagatgcaaactgtcttctatgacatcttggtgaaaattaccaagctcttgacgccaatcttaccacatacggcagaagaaatctggtcttacttggaacacgaagcagaagaatttgttcagttggcggaaatgccagaggtggaaacctttgctaatgaagcgcagcttttagctgattgggaaaactttatggtcttccgtactcaggcacaaaaagccttggaagaagcacgcaatgccaaagtgattggtaagtcacttgaagctcatttgactgcctatgtctcagctgaaaccaagtccttcttggagagcttgaatgcagaccttgctcagttgctcatcgtttcaaacttgacagtaacaactgaaactgccccatcaacagcgcttgtggttgatgaagttgcctttgctgtagaacgtgcagccggtgaagtatgtgaccgttgccgccgtattgatactagtgttgcagagcgcagctatggcgcaacaatctgtgaccactgtgcaagcgtagtggaagaaaactttgctgaagcagtagctcaaggttttgaagcctaagcaatcacaatacatttgttaaagtctatctagcgataggctttttttgtaatacttttcgaaaatcaaaattattcgttgtcaagagccttgatgaactccagttctatcttcggcttcgtttcctaggctacttttgattttcattgagtataaatagaaaaaaagaagccatctggcttcttacagaacgtagacaaactccaaaaatataaaaaattgaagaggtttgcgaaagatagcaagtgattaaactcttagaaacattgatatttcagcgtttctgagagttttttattttcaacataaagaaaaaagattgaagacaattgtccaaaatggaccttttcttcaatctgaaagaagccagatggcttcttacacttctgcgataatgggaatagacatttcaatcaaacggtctgtgtgaatcgtttgaatggcagccttgttaatagttcgttcatcaattttccgatgaaggaagaaatcacgaatttgctcgatttcattttgttgtactgcacggtatttattactaatcaagagttcataatgacggggtgcctgtgtgaaaataacgtctgtattacctgcagaataagtctctactaggaaagcatcagtattagccaactggctttggacaagattgggatgactatttgtcgtgttaatgattttcatgtggaacctcctctatctctttggctacattatagcacgattagagtgtttttactagttattgaatgaattttcttgcaatttccattgttcaatgccccatttgtgactaccacgtttgagtttatcgatggcttcattgactgggaaccaagcaatatggttgaaatcttctagtggttgtcctatttgatggtagctagttacttcatagatgtaggctggattatagaaatgggtatcgcggtggctagagtagaagtattcgtcagcctgaccaaagtattttccgatttcagcggtgaatccaagctcttccatcaattcgcgctccaaagcaatgaggtgattttctcccttttcaatttctccaccaggaagaaaccaagctccgtttggtgcttgaacgagtatgatctgttctttcttttcatctgggataactgcgtaaacaccaaagcgactctggtagctgacgccagccttcttttctccaaatacagcaattttctccataggcaattctatcctctttcattattggaatgagttgtatacattataccacttttttattatttttccttgtgataggctttacaaagtaaagtttttttataggatggagatggggaagaatttagaaaaatagagtagcaaaacagtaaaataggctactcgtagagagcagctctattttcttattttgtctttgtttgtgccttgatttgaattgtacctttacttgacatgacagcacgtaggtctttttctgctggatgttctaagtagaagtcggtgatagcatcttcaatctgatcttggatggttctgcgtagtggacgagctcccatctttggattgtagccaaggtccactaatttctccttaactttatctgttacatggaggctgatgccattgtgagaaaggcgtttgtttacatcgtctagcatgaggctgacgatttcaagtaggttttccttgctcagtggttggaactcaataataccgtcaaatcggttcataaattcaggtgtgaagaaattgctaagttggccaaggactgattgagtccgcccttccatagccgcaccaaaaccgacacttgcttcaacttttccagtaccagcatttgatgtcatgatgataatggtatctttgaagctgactgtccgaccttgtccatctgtcagacgcccatcatctaagacctgaaggaacatgtgcatgacatctgggtgggctttttcaacttcgtcaaggaggatgagtgagtaaggattacgacgaactttttcagtcaattgtccagcctcctcatagcctacatagcctggaggagctccgacgagtttagcgacagcgtgtttttccatgtattcggacatgtcgaagcggatcatgctgtcagccgaaccgaagagttcgatagctaattgcttagacaattcggttttaccgacacctgttggtccgacaaagaggaaggaaccaatgggacgatttggagcaccgagaccgacacgattacggcggatggctttagctatcttgtcaactgcttcatcttgtccgataacatgggcttttaagtcactagcgaggctcacaagctgggactgttccttttcttttaaatcaccaactgggatatttgttttttgctcaacgatggcttcaatttctttttcagtaatgagtggaatatcttcttcgctgatagttgccttttgcatctccttgtacttagcaatttggtcacggaaataggctgctttttcatagtcctcatcccgtgtagcttgtgctttacgattttcggaatcaatcaggcgttggtcaatttcctttggatcaataaagttgagggtcaaattcatttttgaaccagcttcatccagaaggtcaatagccttgtctggtaggaaacggtcttgaatgtagcgattggacagtactgcggcagcttcgatagcagcatcggagtatttaacatgatggtaatcctggtatttattttggatacctttgaggatggtaatggtttcttcgacacttggttcttcaacttttacaggttgcatacggcgttctagggcggcatctttttcgataatacggtactcgttgagcgttgttgcaccgactagttgcatttcaccacgtgcgagggctggtttgaggatattgcctgcatccatgttaccatcgcctgcagagccagcaccgacaatttcgtgaatctcgtcaataaaaagaatgatttcgcgacgattacggatttcttccatgagtttttgcatgcgttcttcaaattgtccacggatacctgttccttgtacgaggctgacaacatccagacgaatgacttccttgtctcgtaatttttgtgggacatcgccatcgacaattttttgagccaagccttcaacaaccgctgttttacctaccccaggctcaccgataagaacaggattgttttttgtacgacggttgagaatttcgatgacacgggtaatttcttgatcgcgaccgattactggatcaatatccccacgacgggcaatttcggtaacgttgataccaaattcttcaaggagcccatttggttgttggggttgttgcggaggaggggtctgtccaccacgtccattatgcccaccggcttgagtgggaggagtctgttcgcgattttttccagcaggggtattgccaggatagccacctaggtgattgaaaaattcactaaagggatccatattgttaggatttgttaaatctcccaacccacgtaggatagcattatgagggtctgttttcatgatttggtagcagttgtgacagaggtctacctgctgctgtttaccgtttaagttggtgtagagatggatcgttgcgtcgttgatattacaatttttgcagagcataattctacctctttctgtgaaaaaatgtgacctattgttaaatagtcaaaaaaggtcagttctagctttattataacaagattcatagaaaaatcaagaaactgctacgcttggaaaaactttctatgaaaaatagggcgataggaagaaaatagggaaaaaataagacttttttggtaatatgtggtaaaatattcctataaaaaggattaggagaacgaatatggaatcacatttggtgagaattatcaatcgtctggaggctatggctaatgacggcggtacgttgaaacgtaatttcgaacgtgatggtattgttgttgcagaagtggcttatagctatgacgaggaaaatggttcagtatttaccttgcgtgatgttgctgctcgtgaaacgtacgcgtttgacagcatcgacttgattgcaatggaaatctatgagctattgtactaagaagaagtgagaggcacctaagggtgcttttttcttgtgtaaattgaatattataaacaaaagtattgcataaatattcaaaaatggtataatagactctaaatgacagaattggagtaagatgaatgaatttttcttttttgcctgagtattgggcttattttaattatggggcaattgttaccctcattattgcatttttctcagtattttttggtagtattttaggtgtgttgcttgcctttgctcagcgtagtaagtataaagttttagcttggactgccaatatctatgtctggattttccgtgggacaccgatgattgtccagattatgattgcttttgcgatgacacattttgtagcaccaacttttcagctaggaattttgacggttgatttgacgcgcttgattccaggtatcattgttatttcgatgaactcgggtgcctatgtatctgaaactgttcgtgcaggtattaatgctgtaccaaaaggacagctggaagcagcttattcgcttggtattagaccaaagcaggcgatgcgttacgttatcatgccacaggctatcaagaatattcttccagccttgggaaatgaatttgtgactattgttaaggatagttcacttttgtcaaccatcggtgtgatggaattatggaacggtgctcagacagttcaatccacttcttatattcctttaacaccacttgtatttgcagcgagctattatctaattatgacaacggtgctaacagtgattattcagtcgtttgagaaaaagttgaacaagggagggcagttccatgtctaatgcgattatttctatcaaggatttacataagtacttcggaaagaatgaggttctaaaaggaattgatttagatattcaacaaggtcaggtggtcgttattatcggtccatcagggtcagggaaatcgactttcttacgtacaatgaacctcttagaagtgccaaccaagggaactgttacatttgaaggtgttgatattactgacaagtcaaatgatattttcaagatgcgtgaaaagatgggaatggtttttcaacagttcaatctttttccgaatatgacggtattagataacattactttatcacctattaagacaaagggaattgcaaaggatgaggctgagaagaaggctaaggaattacttgaaaaggtaggattgccagataaggcaaatgcctatccacaaagtctttcaggtggtcagcaacaacggatcgctattgcacgtggtctggccatggacccagatgtcctactttttgatgaaccgacctctgcactagaccctgaaatggttggtgaagttcttgctgtaatgcaggatttggccaagtcagggatgaccatggttatcgtgactcatgagatgggatttgcgcgtgaggtagctgacagggttatctttatggatggcggtgtcatcgtggaggatggaacgcctgaagaagtctttgaacataccaaggaagaacggaccaaggatttcttgtctaaggtcttgtaataaatgaacaaataagtacgactccgatattgttcggagttttttgctatatgctatattctactttgtacaagtatagtcagtcggagaattttagggtataatagaaaaaacaaaaggagtgtaggtatgacagtcattgatgggaaagcactaggtgtaaaattgcaggctgctttggcggagaaaactgctcgattaaaagaagaaaaggggttggtaccaggtcttgtagttattttagttggcgaaaatcctgctagtcaggtttatgtacggaataaggagcggtcagctctagctgctggattcaagagtgaggttgttcgcgttccagatacgatttctgagtcagacttgttggatttgattgagcgctataatcaggatgatgaatggcatggtattttggtgcaattgcccttaccagcccacatcagcgaggagaaggtcttgttggccattgacccagataaggatgtggatggttttcatccgactaacatggggaaattctggtcaggtcatcctgttatgattccatctaccccagcaggaattatggaaatgttcaaagaatatcagattgagctggaagggaagtctgctttagttattggtcgttctaatattgttggtaaaccgatggcacagctgttattggatgccgatgctactgtaacgattgcgcattctcgcaccaaaaacttgccagatcttgctcgtcaggccgatattcttgttgttgccattggtcgtggtcattttgtgaccaaggaatttgttaagctaggtgccgtggtgattgatgttggtatgaatcgtgatgaaaatggcaagctaatcggtgatgtcaaatacgatgaggtatcagaagtggcaagttatattaccccggttccaggtggtgttggtccgatgactattaccatgttgatggaacagacctatgaagcttgtgtcagaagtgcaaaataagatagagagtttaataaaaataaatatatccatgcctgctttggtaaagccctgttcttagaacctgtatttacaagcgaagtactcatattaagagacagatttagctaatcaaggtaatttttttgggggatattgattgtattttgaaaaaaactaatgatgagtagcttaaaaactagccttagaatagaagcgttgaactgtgaatacaggttcttaaattatgcttgtagttttggtagctaacagtaatgagtgcagtccccgtatgaataagtctatttttaaacgactctacttattttattagtcatattcaataaatcagttttaagacggatgtgacttttagtaatattggttatactatacccaatcctaaatatttttcataatctcctgaaaagcctgatcgtgtgatcaggtttttttgtatgcaaaaatggatctgtacaaaaaaacagtactatttctcaaagtttgaacaacatcccagtgtagtaaaaacgtttggagacagattgtttcagctcaacaactgggaataaagatttattgccgaactcttttatactcttcgaaaatcaaaatcagacgttgttgacttgatttgatgaacttcagttctatctgcatctgcgtcgcctagtctgattttcattgagtattatctgtttagttctttctctctttcattttgtgtttataatgttttaggtgattgtgggacgttttcagtgaaactgctaatggaacggttttactcctagccttatctgagtaataataggataaaactcatatacccacataagagtgatagaggtttgtgaatagtatttagttagaaacatttgttatcaaatacaggttctacgttatatttaaagaacttctctatcattcgttaaatatttcttctccgatttatcgctagataggagcagtgtatgcgtttctaaaaatctaaagttggaggatgttcaattttaaataagttacaatctgcaaatcactactaaaatcaatttatcccttatacagggtaatgtaataaattgttttttctttgtttttcgtatgttttttcaaaaaaatatatgaaacaaatgaggggaatctagtgatgcactagctatgaaaaaaatatttatattaatggaattgtttgagaaatcagaaggatgtagtttttcgatttgcatacatattttaacttaaacatatgtgtgcaaaaagttctgatttttttgtgttttttaagaaattggcattgttgacaaactaaggattggtttggtatcacgtacaggctaatttgatcatattatattcacaaaaatgtatatgttttgattgataggtgatatgttagaagtaaataagcatatattttgtagtgaaagcaatataagcaaaaaggagagaggaagaagcaatgttaaatgcaaaagaccttagaaaaactgaagcgttctgaattatttgaactcttggttgagcaggcaaaggaaatagagtcttatcaagcaaaattagtagatttggaaaaaagaattgagtatcgcgaagcggttttgggagaaattggttcgatagcggaggcgtctctagcagttactaggatttttgaagaagcacaattggctgcaaatatttatcttgaacaagttcaaaaagttacacataaacaatctgataattgtgaaatagggagaacagatgaggatggcgactaataaaaataaggattatgttaccatatcagatttacccagtatatcaataatgtcagaggagctggataaaatacgatataaagagcggtatttagagacattaaaaaatactattttcacgcttgttactgtcgttgcacttgcagtattaatagccatgttatggttgccagttctacatatttatgtaagttccatgtctcctactctgaaagcaggtgatatggtagcaactgtgaagacaaatacactttcaactggagatatggttgcattctactacaataataaggttttggtaaaaagagtagtagcaacttctggtcagtgggtaaatatagatgagcaggggaatgtttatgcaaatggaaaaacattagacgaaccctatgttaaagataaggcctatggtcaaactgatattaaactaccgtaccaggttccagaaggtcaatattttgtaatgggagatcatcgcagtgtatctattgattctagaaatacagctattgggtcgattggtgaggagcaactggttggaaagttaacctttcggatatggccatttcataaaatgggagtaatcaaataaaggaaggagatataaaacatgaaaatattatgggaaagattgtttaaatttgttcagcaatactttcgagagaaaaagactgcaaaaataactatggtgttgtcaataattatggcttttggaatatcatatttgctgattttaccagccattactttagagacagacagtcaggagagtgttctgcaatcagtctataatcagccaacaacagtagaacagccagttcaagaagaacaggcggagtcacaattggcacaggttcaatctgctggaagcttattcgctgaacatgaaaatataactgtacaagttaactatgaggagcatacatttgaacagccagttcggttacaggttttaccctcagaagatagtacaaaatatattggacttgttcggtaactacatcatctcatggttgatgataccacaaatcaactcagttcttaattcaaaccgttttctacgattacgatagggctgtgccatgattttaaaggttttaaatttggcattaaagtgttcaacttcaatacggattttagctatctctcgattcaaccgtctatcctcttcggttaagaggtgatgtttagaatgcttagcaggaataaaggtattttcgtgaaatttcaagatgcctaaataccctaaatctacgaaagcaagggtattttggggcaaactatagccaatactctccttaaaaagggtaaaatcatgcgtatgaccatctgaaaaagccaattgacaagcacgatggctagtcaaatcaggcatgatttgagtctgctagtctttttcttaataactggcctattattgttattatatccaacagtaagtgattattggaactcacattatcaatcagaagcagtagctacttattctgagaaattattggatatttcaaaagaagaaaaacaaaaaattttagaaaatgtcagtgcatataacaacacgctcgaaaaggggacaatacctaatttaaatatagacagtgtagctttaaaaaagtatgactcaattttaaatatcacagatactggtattatgggctatgtagaaattcctaagttgcagacaacgttacctatttatcacggaacggatgatgccgtattgcaggtagcagtaggtcaccttgctgggacttcccttcccattggcggtcagggaagtcacgctgctatttcaggacatcggggattgccttctgcaaaactgttttctgatttagatcagctggttataggggacacatttatgatacaagttttagataacactctgacatacgaaattgataaaattattacggttactccagatgatgtatctcctttgatgatagatccgaatgaggatttcgtaacccttgtgacttgcacaccttatggtgttaatagccaccgattattagttagaggtcatcgaattgaaaatcaactacttgctaggcaagtagtctcagaaggatcaattgtaaaacctatactggtttctccttttattgctttatgtttattaggactactttggagtttattttttataaaaaaagaagtaaatttgtttatgtgacttagataatatcgcaaagaatgtcaaaccattcgactttgttctttagcttttaagcttaggaaagggaggtttttcaactcccaatcatccaaaaggtgaaatagaagataaaccaaatgacgatatgtcaatgtcctctatacgccagaaaaaggtggcaagcgagcggtcggctacggcattgaaattcccaaagaatttgaaggcaaattcaagtttgcccgccaacgctccaaactagctggggaaatccgtggcactttcttcgttgtcaagggtaactatttataggggagaaaatctggggaaactcagattttttgtcgcatacttgacttcaaggtatataatagatatacaaaacgaagggagaatgaatatgaacattaaagaagttagtgatgtaacaggtctatcggcagataccattcgctactatgagcgggtagggcttattcccaaaattgcaagaaaatcttctggagtaagggactttgtggaaaatgatgtagccgttttggaatttgttcgctgttttaggagtgctggtatgtctattgagcgcttgattgagtatatgggcttggtgcaggctggcgatagtactgtggaagcccggattgatttactaaaagaggaacgggaagtcctgcagtcacgcttgtcgaaaattcagcaagctctagaacgtttagattataagatagaaaattaccagactatattaagaggtgcagaaaatcaattgtttacagacggcagtggttcatgcaaaaaagacagagaataactttctctgtcttcatacttcattattaattttttctgataacttgtttgggtttaaatttcttctttagtccaatttgaaccaaacgtagtccaagaaaacccgtcgcacttgccaatatgatggcaataaaaacaggaatgcctacagatagatagacataactagcgatgactgttatcaaactaaaaaatgcgatattaacaaaaaacaacaattcctttagacgttctttattggcattttttgcttgataggtttgaaaattagcctttttctctttcgggatatactcttcgtactggtactcatgggactgatagtgtcttaatggcatatcgtctccttttctgctctttaaagaataccatatcattgatgaattattatgtcatttatattacaataatgttacaagaaggatattagaaaagtctgaatattaaaacacggctagtcacttatcagatatttctctttttgatataattatccttatggaaaaaattatcattacagcaacagctgaaagtattgagcaggtcaaagaactgcttgtagcaggcgttgaccgcatttatgtaggtgaagctgaccatgctcttcgcatcccaacaaattttacctatgatgaactcagggaaatagcagagctagttcatagcgctgggaaggaattgacggtcgctgccaatgccctcatgcatcaagatatgatggacaatatcaaaccgtttatggagctaatgagggaaatcaaggttgattatctggttgtcggagatactggaattttctatatcaataaacgtgatggctacaatttcaagctaatctatgatacatctgtctttgtgacttccagtcgtcagattaacttttggaaagatcatggagcagtagaggctgttttggcaagagagattccatcagaagaactctttgatattgctaagaacttggaaatgccagcggaaatcttggtctacggcgcctctgttattcaccattctaaacgaaccttgttacagaattactacaattttacaaaagctgatgagacagatttgtcacgtggacgcggacttttcttagctgagccgagtgacccagatagccactattccatttttgaagataagcatggcacccatatctttatcaacaatgacattgatatgatgaccaagctgtcagaattagatgaacatggttatcataattggaaacttgatggtatctattgccctggtcagaactttgtggaaattgttaagctttttgttcaagcaagagatttgattgaaaaaggcgacttcacttatgatcaggccttccttttggatgaacaggtacgtaagctccatccagctgaacgtggcttggatacaggcttctacgaatttgaccgcaataaggttaaataataatatttatagcagaatttatttactttaacctgacagagttagctctgtcacttacaatgtaaggtcagagcacgaaaacgcctttgggcgattttctaatctctgccctaggtttccgagtgaaacaacatcgtttacagtattctatcctggcagagttagctctgtcacttacaatgtaaggtcagagcacgaaaacgcctttgagcgattttctaaactctgcactaggtttccacatggaaaagtatcgtttcatgtggaaaccgtcgcaaatagaggagattttacatgatgtcaaaaacattaaagcgtcccgaggtcttgtcacctgctgggactttggagaaattgaaggttgccattgattatggtgctgatgcggtctttgttggcggccaggcctacggtctgcgtagccgagctggtaactttaccatggacgagatgcgggaagggattgaatatgcccatgcccgtggtgccaaggtctatgtagctgccaacatggtcacccacgaaggtaatgaagaaggagcaggagcctggttccgcgaattgcgtgacatgggcttggatgccgttatcgtatctgacccggctctcatcgttatctgtgcaaccgaagcgccaggccttgaaatccacctgtcaacccaggcttcttccaccaactacgaaacctttgagttttggaaggaattgggcttgactcgtgtcgtcctggcccgcgaagtgactatggaagaggtggctgaaatccgtaaacggacagacgttgaaatcgaagcctttgtccacggtgccatgtgtatctcctactcaggtcgttgcgttctctccaaccacatgagcaaacgcgatgccaaccgcggcggttgctcccaatcttgccgttggaagtacaacctctacgacctacctttcggcgaagaacgccgttcgattaagggggaaataccagaggagttctctatgtctgcagtggacatgtgtatgatcgaccatattccagatatgattgaaaacggggtcgatagcctgaaaatcgaaggccgtatgaaatctgttcactacgtatcaacagtgaccaactgctacaaggctgcggtagatgcctatcttgaaagcccagaaaggtttgaagcgatcaagcaagacctgattgatgagatgtggaaggttgcccaacgtgaattggcaacaggattctactatagcccgccgagtgaaaatgagcaactctttggagcccgccgcaaaattccagaatacaaattcatcgccgaagtagtggcttttgacaaggaaaccatgactgcaaccattcgtcagcgtaatgttatcaatgaaggtgaccaagtagaattttacggaccaggtttccgtcattttgaaacgactattcaggacttgcatgattcaaatggagaaaagattgaccgcgccaacaagccgatggaactcttaactattaagctggaccgtgaaatctatcctggtgacatgattcgtgcctgcaaatcaggcctcatcaacctctaccaagaagatgggcaatctctaactattcgtgcataaacatatagacatttagtttttcttttattacttcgacgtaagaggaaactccgtttccttatttccaacttcaaacactccactggattgtttgaactcgctttgccgtactctgcaggggtgacttgctccgcaagtgctatctccaacctccaaaggttccccaaacctttggagcgagtactaaaagtaaactaaaagactataaaaaggctgaaatttcagcctcagaacgtagataaactcttaaaaatataaaaaaatgaagaagtttgcgaaagatagcaagtcattaaactcttagaaacattgatatttcggcgtttctgagagtttttaattttcaacataaagaaaaaagattgaagaaaattgtccaaaatggactttttcttcaatctgcaaggctgaaatttcagccttttgtttgttgttgagaagtcttgatgctatctggaaccaaggtgacttttttgatgtcctcgatttttataatgctggtaacctgacgtttgaaatttttcatgataatccgttggcgatcggtatcatatttcacaatgtcacctgtgaaactacgatcaccatagatgacatggactgcagcttttttatataaagccagctccaagttattcttgatttcttccttgctatctggctcaatagacttaggagctttgccatgttctaaaaagatggtgaactgctcgaaaataacttctaaaaacctcttcatggcgtaatcctttcaaacttgatataattatattatctaatttttataaaaatgacaagctttttcgaatagataagtgaggaggtaacaaatggcagaatttacatttgaaattgaagaaaaattattggtcttatctgaaaatgataaaggatggaccaaggagcttaatcgagtatcttttaatggcgcaccagccaagtatgacatccgtacctggagtcctgaccataccaagatggggaaagggatcactcttagtaatgaggaatttcaagttctactcgacgcgtttgctaataaataaatgaaggaagcctaagcaaaataggcttcttttttgataacaggttgcaataaacgatgacaaatcatgactagtgtaattttagctaaatcaggaagaatgaaaggcagaacagtccagccgatagtgtcagtccaactggcacctgaaactagtttaaatacacaacagccgagaaggaaacagatacttgttccaagtaggcaggctagaaaaattgtaactggtgaggagtctgatttagtgagggcagaagtgatgatagtgtagagtagaaacccccatagaaagccagatgtcggtcctgtgagtgcagcaaagccaccagaaaaaccagcaaaaacaggtaaaccgatagcgccaagaactagatataagctgacacttgtaattgcctccttgggtttgtatagacaagctactaagccgatagctaaggtttgtaatgtaaatggtacaggtccgatagacagactgatttgtgaaagggtggaaattaaggctgttccaatagcgatataaacaagtgatttgatagaagttgttttcatttgttatcctcttaaaattttatggttaacaaaaattatagtgagattggataagaaagtcaatgctctttcatcggctgtaacaactctataggtgatttttataacagctaataagaaacttatatagttaaaagcaataaattatatgtaaaacaacctatacctatgctagaataataaaaaaagaaagtgagaatttctatgacagaattacttgatatttaccgtactcttaaatctaaaacttgggtagacttgactcaccaaatcaatgaaaagagcccgcatttccctgcgctaccagctctcgaaaagaaagccctatttactcataaggatggcttctttgtcgaacaatttacggttgtggggcagtacggaacccatattgatcctccgattcattttgtagaaggggctcgttatcttgatgagattgatttgaaagatttactcctgccactctacgttattgataaatcagctgctgttatagaaaataatgactatgagataactaagcaggatattttagactttgaggctgaatatggtccgatagcgccaaaatcttttgttgcctttcgttcggatttgtcaaagcgctggcctagtcaagatgccattcgtaatctagacgaagatggagttcaacgtacaccaggatggagtcatgaagctctagaatatttgattgaagaacgtcaggtgaaagcagttggtcatgaaacattggataccgattcaggagtatctgcagccaaacacggaggaagtttatcagaagaatactatctcctatcaaaagatatttatcagttggaagtattggcaaacttggatcaggtaccgccaacaggtgcattgatttcaatcgcttttcctcattgggagaaggcttcgggttcaccagtgcgagcaattgccatattaccataaaaaaagtccagacagtgctgaccttcatgtctggactttttcaattgagttaacgcatagtaacaaattcttcagaacctgtcggatggatggcgacaacggcatcaaattcttcttttgtagctcccattttgatagcaactgagaatccttgaatcatttcatcgacaccatagccaatgccgtgcagtccaacgactttttcattttctcccacagttactaatttaaacttagccatttggcgattgttttctagggcagtgtacatagaagtaaaggctgaagtatagacttttacattgtcctgaccgtattgggtaatcgcttcgtcctcagttagaccaacggttccgatagcggggtgagaaaagacgacagttgggatggttgtgtaatccatttttgcggttggtttattgttaaataaacgttctgccaaaaggcgacctgccttgattgcaacgggtgttaattctttttcaccagttacatcaccgagggcatagatgcctggtacagctgtttcttggtattcattgacagaaatatgtcctgaagaagtaagttgaacactagttgctttcaggttgagtttgtcaatatttggtttacgtccaattgcccaaaggaccttctgagcaatatggttactaccgtcagcaaagttaatctggatttgtccatcatcagttttttcaagactgacaggagttttcccggtatggagtggaaggttggtacgttgcatttcttccatcaaggcatcaacaatgtaggtatcaaagctacgaagagggcgattaccacgaacaaataggtcagtttggacaccgagtccatgtaggagaccggccatttccacagcgatataaccagcaccaatcacagccacagaagagggtaattcttcccatgcaaagacatcgtcagatacaatccctagctcactaccaggaatagcagggactaccggtttggcgccagttgtgatgacaatgtgttttgcacgaatcagttcaccattgacttcaaccgtttgattatccacaaaacgtgcgaaaccctggataacttctacttcgttattgttaaaagtattaccgtaggatgcgcgtgaacgctcaatataggcttcgcgatttttacgcaaggtggcaaaatcaaaggtcacttcttggctagtaaatccatattcaggtccataatgctgaatggcttctgctacctgagagccgtaccacataatttttttgggtacacagccaaggttaacacaagtccctcctagatagcttccctcaataactgctgccttggcaccgtacatagcagctcggttcatggtagcgatgcctccgctcccaccaccgatagcgataatatcaaacactttcataaatttcctccaataaaggtcaataattatattcattgtaacgcttttttgtatgtcaatcaaaaatctgctacgtcaccttacaaaaatgtaagtgggaaaattgccgaactttttataaaatagttaggaaaaaacttgcatttgttcttgtatttgtgtattatatagacaacacaaataggtatgttttgtaaagaaaaggagtttgttatgttaaaaacaaagaaagcaaaaattgctttgtttggtggtcttggagtggtcgcagttgccttagtaggtggggctttgatttttagcaatatgctaacatcaccatcatcttcagaagatgtagccatgagtatgacctatactgttgctaaagaaggctcaattgcttcctcaacgctacttacaggaacgattacagcagcagacgagcagtatgtttactatgatccttctaagggagatttgagtgaggttttggttgctccaggtgctaaggtcgaagtaggtacccctttgattcgctatgatgctacagaattacagtctgctttggatactgctgttcgtggtcgtgataagattggtcgccaaattgcagacttaagaaccaacggtcagactgttcaaacaactggtgatgcagaaacagatgctgcagcaactgctactgcacaacgttcagtagatatgcagttggcagacttgaatgattcatacgcagatgctcaagctgcggttgataaagcatatacagccttaacagaagcgacagtaactagtaccgttgctggtacagttgttgaggtgaataaggctgtttctaagaattctacatcgagccaaacagttgtacacattgtaaatcaaggtagtttgcaagtaacaggtagtttgacagaatacgatttggctaacattgcagtggatcaagaggtcaagctgactagcaaggtatatcccgataagacttggacggggaaaattacctatatttcaaactatccatctagtaatcaagctggtgctgctacaacaggaaccagtggttcaggtgccaaatatccatttaaggcagctttaactagtgaattaggtgagttgaaacaaggattttctgtaaatattgaggttgtcaatacaagtaaaaacattttaattccggtgtccgcagttgtgccagaagaagataaaaactatgtgtggaccttggttgatgggaaagctaagaaagtagaagttactctggggaacgcagatgctttgaaccaggaagtgaccgctggtatagcagcaggagataaggttattaccattccaactccgaatctcgaagatggcaaagaggttgaagccaatgaagaaccagcttattagactaacaagtatcaataaatcctacaaaaatggtgatcaagaactccgagttttaaagaatattgatttagaggtggaagagggagaatttcttgccattatggggccctctggttcagggaaatcaaccttgatgaacattattgggcttttggatcgtttcagttcaggaaactattggctggaaggtgaagaagtcagtcaactttctgagaaaaaattagctcaggttcggaatgaccaaatcggtttcgtctttcaacaatttttcctcttatcgaaacttaacgcccttcaaaatgtagaattacccttgatttatgctggagttccatcaagcaaacgtaaggaactagcaaaacagtatcttgaaaaagttgagttggcagagcggatgacgcatttaccatcagaattgtctggtggtcaaaaacaacgggtagctattgctcgtgcactagtcaataccccagctattattttagcggatgaacctacaggggctctagataccaagacaggtgagcagattatgcaacttctgacggagttgaataatgaaggaaagaccattatcatggttacgcatgagcctgagattgctgcctacgcaaaacgaaaaatcgttctacgtgatggagtgatcactgaagatagtcgaagggagggagtttagatggaaaattggaaattcgccctcaaatctattatggctcataaaatgagatcgctccttactatgttaggtatcatcattggtgtggctgcagttgtcattattgtcgccatgggaacaggggtggccaaaagcatagaaaagtctctagctggtgatcaaaataatgttcaggtttactttactgctttctccagttcaggtacagctttcggtccgtttggcacagcgtcgacagaagaaccaattttagaggaagagccggatttgacggattctactttaaaaggactgctagagattgatggcgtatcaaactattactccagcatcagcaacatagctgaagtcagatcgggcaataaaaaagcagagaatgtcactattactggtgttagccagaatttctttgctgtgaaagagtatgagattttagctggtcgtcagtttacagctaacgactatagtcgtttttcacgtatgattatgttagatacggcattagcagagaagttatttggttctatagagaactctctcaatcagacgattagtgttaatagcaatgcctatctagtaataggggtctacaaagatccgaaagcaggcacagctatttatggaatgaattcaggtggaaatgccgtcatgactaatacgcagctagctgctgaaacaggcatgaaagaaaattctcaaatctttgtccatgttgaagatgttactcgggcaacagaagttgggaaggctgctgcagattacctgactaaagcgactggattgaaagaagcgagatacgagatttatgatatgtcagctatgttggaggagtttaaatctcaaatgtctggcgttacattgtttatcggtgctgttgcaggtatctccttgctagttggtggtatcggtgtcatgaatatcatgctggtatcagtaactgagcggactcgtgaaatcggtcttcgaaaagcgcttggagcaactagaggaaatatcttgattcaattcttgatagaagccatggtcttgaccactcttggtggagcaattggtctcgcaatcgctcagacaatagttttcttgctcaatgtgagcaaggcgttgggcgaaagaatagctgctgaaatttcaattcctgttgtgttaggtagtctggctttctcagcagtagttggtattgtatttggcgtactacctgccaacaaagcatctaagcttgatccaattgaagctttgcgctatgaataatctattgaaacgattaggttttcctagtcgttttattttttgagcaaattaattgaatttatcactaattagcgataaaataaacgcatcaattaagaaatagtgatttcaaaggagaacacatcatggtagaattaggtatttcaacatttggcgaaacaactccactagaaaaaacaggggaaacttacagccacgacgagcggattcgccagctagtcaaagaaatcgaactagctgatgcggtgggacttgatgtttatgggattggggagcatcaccgagaagattttgcggtttctgcacctgagattgtgctggcagctggtgccgtcaataccaagcatatcaagctaacatcagcagtttcaatcctttcctccatggatcctgtaaggctctatcagcagtacaccaccattgatgctttgtcaaatggcagagcggaaatcatggcgggtcgtggttcctttacggagtcattccccttgtttggctatgatctccacgactatgaagaactcttcgatgaaaagctagatatgcttctggaaatcggcaaggaaaccaatctcaagtgggatgggcattttacccagtcagtcgataataagccagtctatccacgtcctgttcaggaagattttccgatctgggttgcaactgggggcaatgtagagtccaccatcaagattgctaagaaaggcctgccaatcgtgtatgcagtcattggtgcaggtgcccatcgctttaaacctttagtcgatgcttatcgcaaggttgctcgcaactcaggtcatgatccaaagaaaacgaaagttgcagcccattcttggggttggattgcagacgaccatgacaaggctgtggaagaatactatcatccaactaaagtaattacggacaatattgccaaagaccgcccacattggagcgagatgaccaaggcgcaatatctctactctctgacagacgaaggagcaaccatcgtcggagatccaaaacgagttgctgaaaaaattatcaagactattgaaacacttgacttggaccgtttcttcctccatctcccaatcggctcaatgccacatgaagatgtcctccgtgctatcgaactctacggaaaagaagttgtgccaattgtccgagattattttgcaaaaaaagaagagaatcagtcccaggactgatgagataaaaaggatgggacgttataatagcctcacttctctaaagtggagtcaacatctcagcgcagtggttgattggaagatttgttcgtgttttacactccacatcttcctctacggctgaagcgaacggtgttcgctttatttccgacctccaacagtcactattctgactgttctgtagcgaactctgttcgctctatctccgacctccaaaggttccccaaacctttggagctgtgcgggggtgggagtgaaacagtctggggatagactgtttcagctcaacaactggaaatatgaacttgttgacgaactctctatgattatttgagttctttcccactcccaatcctaaatatttttcataatctcctgaaaaacctgaccatgtggttgggatttttgaatgcaaaaacactcttggaatttccaagagtgttttacgtaacggtgttaaacagtttgtaatttttatttcatcgtcgggagtgagaaggtctggtagaccttttcagccaatcgccaagaaactggagagcgatttgaacatcctagtgaaaacaaacctagcaagctactcttgcttacttcatagtagggaatagcaacacatcccgaatagtagttgtatctgtcaagagcatgcagaggcggtcgataccgattccaagtccacctgttggtggcataccgtattcgagggcttcgatgtagtcgtagtcaacgcctgtcgcttcgtcgtcaccgagttctttagccttggcttgggcttcaaagcgttccaattggtcgattgggtcgttcaattctgtaaaggcatttccgtattccttggtcatgatgaagagctcgaagcgatctgtgaagcgtgggtcttcatcgtttttcttagccagtggagatacggctactgggtgaccatagacaaaggttggttggataagagttgcttcaacgtattcttcaaagaagctgttgatgatttgaccaacttctgtatggtgtttttccacagggaccttgtgctcagctgcaagggcttttgcttcctcgaagctcatctcttgccagaagtccacgccagtttgttccttaatagcgtcaaccatgtggatacgcttgaatggctcgtggatagcaatttcagtgccctgataagtcaccggaccatcaccgacaacagccttggcagtgtgctggataataccttcggtcaagtccatgatgtcttggtagtctgcataagcttggtaaacctcaatggaagtgaactcagggttgtgggtcgcatccataccttcgttacggaagatgcggccgatttcataaacgcgttccataccgccgacaatcaggcgtttgaggtggagttctgtcgcgatacgaaggaccatgtcaatgttttgggcattgtggtgggtgatgaatggacgagctgcagcaccaccagcttcgttgtgaagaactggtgtttccacttccaagaaaccaagtccgtcaaggtaacggcggatttctgagataatttttgagcgggtcacaaagcgatcaaagctctcgcggttagtaatcaagtccaaataacgtttgcggtagcgggtctcgatgtctgtcaaaccgtggaatttttctggcaatgggcggagcgctttagacaagtgagtcaacttgcgagcatggatagacaactcaccaacgtttgtcttgaagacatctccctcgacaccgataaagtcacctaggtctgcttttttgaagatttcatagttttcttcgctaacatcatccttacgaacgtagatctgaatctggccttcgcggtcttgaatgtgagcaaaacctgccttacccttaccacgcttggtcataatacgacctgcaatgattgctgtttgccctaattcttccaagtcttcttttgatttgtcttcgtactgggccttcaattcagctgagttggcagaacgctcaaaacgttttccaaatgggtcaatgccttgttcagcaagagccgtcattttctcacgacggacaatctgttggtcatttaattcttcaaaatgttcagttgacataaaaattttattcctccaaagtctgttatttctattttatcatagaagagagaaaaaatcagtataaattgctaataggataggaaaaaacagcagaaaattctactgttttgctttatagctggtatcattccaagctaattctgtaaagttttcgaaatcgcttgtttctaaaatagtaaccgatgcattatccaaaccacctcggtgacgcagttgggctggtggaaaaccaagtaggcgatggatagaagcggttagaaaagcaccatggctgacgatgaggactgtttccatgtcttgccctttcagcgattggacaaagtccaccattcgttgagttacctggcgaacgctctcagcttcaaataagtcattgttaaaaagtgctagattatgtttgagtgcccaggcttgtttgggatagatggcacgaaaaattgccatcttgcttccttccagcgttccaaaattccattcacgtaattgttgcgtggttagaacggtttggcaatggtgattggctttggcaatttctacggcagtgctatgtgcgcgctgcaaatcactagaataaatagcatcaaaggggatttcagcaaggtatttgcctagtttttctaaatcctgataagattcaggcaagagagctgaatctccagaatagccttgaaagcgtccctccaaattccattcggtcttaccgtgacggacaaagtagattttcaagtctagtccctcccctcgatcaaatcggcaaagtcagcttttacaaaatcagctaatacctgactgtcaattcgaatcgaccgaccaatttctccagcagagacaatcaagtgaccgagttcaagggcagattgatcaatgtagattgggaaattatgcttctgacgaatgcctacgggattgttggcaccatggatgtagccagttgtcttttccaagtccttttgcggaatcatactcacttttttattgccagagatcttggctaattttttctcagacaggtgttctgtgattgggataatgccgataattggtccagttttatctccagttaatgccagtgttttgtaaatttcgtgttcttcaattcctggtggaagttgaccttcgaaggcatttaaaacaaggctatcatgattgatcttagccttgtccaatatttggtccaccaaggttttctttattttaaccttttttgccattatttatatttttcctcaagtttactcatccaaagccctaaccatgctcctagtataaataggacaatagcagcaatccatgtaacaaagttagcgccagcataggaaatagactctttattacttgcttgtggaatcaaaattaggagagtagaagatgaaacgataccaataataaagtgataaacacgtgaatggtatactttcagagcgtggtccattgcttttgaaaatgcaaccattgcaagaacgccaccgattgcgattggtaggaaggtaccgaatagatcaagtgatttgaaaccatttagcattggcgtgtagatacccaaaatcaatagtaagtttgaagggctgagtccaggaacaagtacccctaaagcaatcaaggcacctgccaatacaaaactagcaaaagtagctggaagtgtcccgacaagatcgctcaaattgtaaagtaggaggccagaaataatgaatgtcccaatcaaccaagccaaatcaatgctatctcgtttgctcttttgagttgattctttaagtaggctaggaatcgttcccacgattgctcccgcaaaggcccacaaaactgggacttggaaatgttgcaataaaaattctacagggaaagagaaaagtgcgattcccaaaattccaccaattcctacaggaacaaaataaagaaagttttccttgaaatcttttcgaatatttgctaaaaatccaattagtcgctcatagattccgaggatagcagcgagtacccccccagagacaccaggtaagataaagccgagtgcgataatcatacctttaataattcttgaaatccaagaagccataatttcctccaaaatgtattataacgttcctattatagcataaagcaagtaaaaataattaaaaagactgcctgttagataaaatccagcaggcagttttggttaaagattgtaaaaacctggtcttgctctatagagtaaaatgagcagaatagaggcaattgctgtggaaggaagaatatagctgatattgtaggtaaaggaatagaaccagacaggcataccatctggagcgtagtctgcgtagaaaataattcctgataagaaggtggctaacaatcggatgcttcctcctagaaaactagccagagtaatgatgagagtagcattttttagattgttttgtttggatagggtgggtgccactaaacctgctaaaccaattccggcgtaagaaaatgcgtagtcgagaaaaacttgaaaaacgtttaggaagtagccaccgtagaaaagttgaatggttcctacaataccaccagtaagaactcctacccctagtccgtggcgcagagcaagcagtaagattggaagcatgactaaagacacagatccaccttggggcattgtaaagagcgggattttgtcaaagacgagggcaatggcagaaaagatagcaacttcagctaggatgggtaattttgatgtgggcataaaaagactcctttgtagatggtcaacaaaggagtgtttatagcagagtatagtatcattctataaagcacacaattcctacgctagttttaactagatcaggttcgaggatttcgcagttgcgatctcagccgaagcactcctttgtgtatatgtaattagtgaaattgtatcattttattcgggtgttgtaaatagtttctgataaacttcattaggatccttcagggtagtaataatgttgaggtctaggtggtgctcaaagccgtttacataaccacgtgaggtatattggtgaagatcgtagttcaagtcagtatttggagcggcattgtagtagccagaatcatcaccgtatgtaggaatccaaatagcgtcaaatttatccacattgatgctgtggtcttccatgaaataggttccgacgtaaattccaatgtttttagcgccgagagtttctaactcttttcgaaaagcctccactccagcattcatatcatccatggtatattcttcgacgtctaaccaatagaaggttggcttgtacttatttgcggccttataaaagcttcgagcttcctctcgcatgttctcaatactatttcccgtgacataggcatagacagcaacaggtatatttcttgcttgaaattctttaatatgggtatcaaaggatttatctaacccatttttatcagtcgcagtattttcgtttttagtgtgtgatccactttgaatacgaacgatggcgccagaaatgtttttgctaagggtatcgtagtcaatttcagacggtctctgccaagcagaaacgtcgatgataggtttcatttcgagcgcatttgcaatgtaataactcgaactagaatttgttgttttagaacttgtactggtgtttgattgtgtgactgcgggttcgttagctacctccgtcttatttacagtatttccagtcaccccagtgatgaaaataagagcaaagaaggataggaaaaaaccaacaacaatcatcggatttagtttctttctcatctcctcaattctaccgtaaaatcatgaaaaaatcaaaaaaatacgattcaagaaatagtaaaagattatctgaacttgacataataaagggaatagggtaggctaaattggtatgcatgacaaaagtgaaaaagtaagacgtgttagtcagctagttgttctgtcctatttcagtttgctggagagctggatattgatgatactagtgatggtagggagtggcttgctttttggatttggcacagttgttttgtggcaagttcttagttttgcttttatccaatttatatggtggttggcaatcggtccttttatcaaaaaagagaacattcccttgtggctacagagtcttctggcggggattcttgtctttttgtatgggctaacgataagttttttatctgctacacagtttgggacttctcctatcgtcttttggcttaatggtttagtctttgatagtttacacgctacttcaacagttttgttttatccaattattgattatatttttaggagattttataaatgaaaaaaattagtattatgttgatggttgtcttctcgctcttcttggctgcttgtacaaacactaccgagaaacagaacaactcggctatcgaagtcactttgcagattacaaccaaggacaaagagaatcgtcaggaagtcactgcggaagaaggtgatagtgtcatggatgtgcttaaagaacatcatgacattgtagaagacaatggtttgataacagaaattgatggtgttagccaagatacgagtaccaatacatactggatgtataaagttaatggccaaatggctgataaaggggcgaaagaccttacagttgcgaatggggatgaaattgaattttatcttgaaacatttgaatagatatgaaaggcttcggcctttttcttgtcgacaaaagtcagttccgaatgtttgcagagcaacttagaaagtgataagtatttttatacaaagtatgctataataagagctatactcgaagaaggttggataagcaatgaagattgacaaacgccagttgttgaattattccatactgattccctatctcatcttatcggtgattgggttggtcatggtctattcgacaaccagtgctacgcaaattattaatggtggaaatccatttagaacagtgattaaccaggcaggattctggattgtcagcttggtagcaatctatacgatttatcgtatgaaattaagttttttacgcaagaaagccgttatctattcggttattttggtagaagtatttctgttagctatttctcggttgtttcctccgattaacggggctcatggatggattcctctgccaatcgcaggaaccttgcagccggcagaatatttgaaattaattatcatttggtatctggcacatgagtttgcaaaacaacaggcggatattcggacttatgactatgtatcgttgattaaaggaagttggattccgaaagagtttacagattggcgggtggtcagtctgctcctcctaggtctagttgcgacactgccggacttgggaaatgcgacgattattgtgctgattatggtcgtgatgattagtgtgagtgggattgcctatcgctggttttcaacagcggttttaggaattgtggccgcctcaacagttattctagggacgattcgtattttgggtgtagaaacggtggaaaaaattccgctctttggttatattgctcgtcgttttgctgcctattttgatccatttggtaatgccaccaactcaggtcttcaattgactcattcttactatgcgatgagtaacggtggatggcttggacgtggtttgggaaattcgattgagaaaaaggggtatctaccagaggcccacaccgactttgcgttttcgattgtcattgaagaactcggttttgttggagctagtttaattctagccttattgttctttttgattattcgaattattattgtaggcgtccgtgctcgtagtccatttaatgcgatgatggcacttggaatggcaggtatgcttctgattcaaacatttgtcaatatcggaggaatttcaggaattattcctgcaacgggggtaactttccccttcttgtcacagggtggatcgagtctcttgattatttccatcgggatagggtttgttttgaatattgatgctagtgaaaaacgtcgattaattgaagaagaaatagagcgtacgctaatttagagataggaaagaggtaggagatggctattcaaaaattagaaaactataacaacaaggaagcaatccgtgaagaagtaacgattctaacatctattttggaagaagtagcagcccaaatgatgcctgcagagacttttgctaaaattgtagaactatctcaattgtctcgtcaagatgattatcaggcattgattgctattatcagtcagttgaataatgatgaactagcggttatttctcgatactttgctgttttgccacttttgattaatatatcagaagatgttgacttggcctatgaaatcaaccatcaaaacaatattgatcaagattatcttggtaagatttcaacaacaattgatatggtttccaaacaagaaaatgcagctgaaatccttgaaaagttgaatgttgttccagtcttgacagcccatcctactcaggttcaacgccagtctatgcttgatttaaccaagcatattcatgagttgcttcgtcgttatcgcgatgtaaaattgggcttgctcaataaaaacaaatgggaagatgagctccgttgttacattgaaattatcatgcagacggatatgattcgtgagaagaagttgaaggtaaccaacgaaatcacaaacgttatggagtattacaattcttcctttattaaggctgtcactaagttgcagcgggaatacaaacgtttggccgctgagaaaggaatcgtcttaaataatcctcgtccaattacaatgggtatgtggattgggggagaccgtgatggaaatccatttgttactgcagagaccttgaagctgtcagccttgactcagtgtgaagtcattatgaattattacgatgagcaactctataaactctatcggaatttttcgctctcaacttccattgtaaatgtatctacagcggttaagatgctggcggatttatctgaagatagttctgtctaccgtgaaaatgagccttatcgtcgtgcttttcactatattcagatgaaacttgcaaatacaagagattatttagttcacaataagccgtcagatgttcgctatagtaatgtagccgagtttaaagctgatttattagccatcaaacaatctttggtcgaaaataaatctatggcgctattgaaaggtgattttacagaattgcttgaagcggttgaagcgtttggtttctacctagctagtatcgatatgcgccaagactcttctattcatgaagcaagtgttgcggagttattggcctctgctcgtatcgtagaagactactccagtttatctgaggaagctaaatgccatgttcttttgaaacagttggaaacagatccacgcattctttctgcaacgcacatgccaaagtcagaacaattagaaaaagaattggcaatctttgctgctgcacgtgaattgaaagataagctaggtgaggaaatcatcaagcaacatattatttcacactcggagagtgtttctgatttactggaattagctgtcctattaaaagaagttggtctagtagatgtcgataaggcccgtgttcagattgttccactttttgagacaatcgaggatttagataatgcacctgataccatgcgtcaatatctgcaattagatttagcgaaacgttggattgcaggcaataaatactaccaagaaatcatgcttggctactcagattccaacaaggatggtggctacctatcctccggctggacactctacaaagcacagaatgaattgacgcaaattggtcaagactacggagtaaacatcaccttcttccacggtcgtggaggtactgttggtcgtggtggtggtccttcctatgatgcgattacatctcagccatttggttccatcaaggaccggcttcgtttgacagaacaaggcgaagtgataggcaataaatacggtaacaaagacgcagcctactataatttagaaatgctggtatctgcaacgcttgaccgtatggtcacacaaatgattaccgatccaaatgaaatcgatggctatcgcgaaaccatggatgaaattgtatcagatagctatcgtatttatagagatcttgtattcaacaatccacatttttatgattatttctttgccgctagtccaattcgtgaagtatcaagtctgaacattggctcacgtcctgcggctcgaaaaaccatcacagaaatcggtggtttgcgtgcgatcccatgggtattctcttggtcacaaaaccgtgtcatgttgccagggtggtatggagttggttcaagtttcaaacgctttattgataagcaccctgataatttgtctaagttacaaaaaatgtatgaatcttggccattcttccgttcacttctatcaaacgtggatatggtattgtctaaatccaatatgaatatcgcatttgaatatgctaaaatgtgtgaaagcgaagaggtacgaaatatcttccatgtcattttagatgaatggcagttgaccaaagaaattattttgtcaatcgagcaaaatgatgagcttttagcagaactaccgtttctaaaagctagtcttgattatcgcatgccttattttaatgtgctcaactatattcagattgaattaattcatcgtcttcgtcgtggagaattgagcaaagaacaagagaatctcattcatattaccatcaatggtgtggcgacaggtttgcgcaactcaggttaataggcataaaacaacttcttcggaggttgttttttttgctgataaaaatatataataatcataagaaagtgtaaccaaatcatcccttattcgttctattagtgaaaggaggagatgagtatcaaacttgatcaatatgaaaaagaagtcattggtattgctgaggagatttcctactatctacaaaaatctggcgccaactatgcagatagtcaggacatcgcacaggatatactagtgaaaattttagaagcagagcttgtccttcctttcgaaaaactaagagcttggctttaccgttctgcagttcgggcttacattgacaaatacaggcgagacaagcgctaccatgaaattttacaaaaggagttttttacacctgaaaattttttggtctatgaccaagaagattatgaggaactctatcaagctgttgcagacctgccagaaaaataccagcaagtgattgacttatactacttccaagatatgagtatcaaagagattgcgcatattttaggtgctggtcaaagttgggtgaaaatcagccttcaccgaggacgcaagcagttaaggaaaatactagaagagagaggatatgactatgaagacttttgaagaggtgacaaaaaagagtaagcggaaaaatttatggaagacagttggactatcatcgttcatcggctttatcttattgttgattggcattcaaactgtaaaaataattgtcggtgcacgagaaggtagtgagaattggaaacaaattattttaatggaaatctcttatccaaatataaaacatgacggtattaaaatccaaagcacgagttatgtttctgggaaactttactgcaatttatataaggatctagctggtgttcctatggcttttggtcagcacgaaatttactatgacctgtttgatcgtcactatgattttgctcagcatatacccgggaataccttcaaatatctatatgatttcacaaccaataccaagatacctgttttttacaatagaaaaaagtccgtttggagtgttcaagacattgccaatgaattgcattatcttaaagacatgagtgggcagctagtagaagtggctatttcctttgataagaagtatagtttggcagaaatcaagcaaatgattcccagcaatctcaagcaaaattggtattggatagggacagaagggaagcagaatacccattactatcgtccagagcagcttttggggttagatccagaggatattcaactagtcttttcggatatgcctggagactatatgacaggtatggactttatgaaagagttcttagaatcgggagatcagaaacgagcgcagtatctggacatacctgtggatgacttgcaagcctttgttgacaaatttggcgatacagactttactaaacaagaagagattgataagctagaatttgcaggcattatcctaacaggaaaagcagaagactttgcccagttggaaggcaaggactggatttattcttctagtattggcgcgtccattcctattcagccttattatcaactgcatcattaagtgaaaatagtcaatatattttcaacacctatagcaagaggcttgtcagggagtcgtaggataactgaatggagaaaggtctgtcgcagtggtctcgtatttgtggcaccttgtagctatggtaacatcaatattcttacggaaatgaggtgtttttagttgagtaataggttaaaatgggatgataaaaaaagttataagcgaagctaatagcccttgcagaaaatggataaaataaaaaacgatagaaaatgcttgcaattctgctacaatttgatagaatagtaaggtaaagttagactgtattgcctactgtctatctataaaatatattttattggaggcttttaccaaaatggcaaaagaaaaatacgatcgtagtaaaccacacgttaacattggtacaattggacacgttgaccacggtaaaactactttgacagcagctatcacaactgtattggcacgtcgcttgccttcatcagttaaccaacctaaagactatgcgtctatcgatgctgctccagaagagcgcgagcgcggtatcactatcaacactgcacacgttgagtacgaaactgaaaaacgtcactatgctcacatcgacgctccaggacacgcggactacgttaaaaacatgatcactggtgctgctcagatggacggtgcgatccttgtagtagcttcaactgacggtccaatgccacaaactcgtgagcacatccttctttcacgtcaggttggtgttaaacaccttatcgtcttcatgaacaaagttgacttggttgacgatgaagaattgcttgagttggttgaaatggaaatccgtgaccttctttcagaatacgatttcccaggtgatgatcttccagttatccaaggttcagctcttaaagctcttgaaggtgactctaagtacgaagacatcgttatggaattgatgaacactgttgatgagtacattccagaaccagaacgcgacactgacaaaccattgttgcttccagtcgaggacgtattctcaatcactggtcgtggtactgtagcttcaggacgtatcgaccgtggtactgttcgtgtcaacgacgaaatcgaaatcgttggtcttcaagaagaaaaatctaaagcagttgttactggtgttgaaatgttccgtaaacaacttgacgaaggtcttgccggcgataacgttggtgtgcttcttcgtggtgtacaacgtgatgaaatcgaacgtggtcaagttatctctaaaccaggttctatcaacccacacactaaattcaaaggtgaagtttacatccttactaaagaagaaggtggacgtcacactccattcttcgacaactaccgtccacagttctacttccgtacaactgacgtaactggttcaatcaaattgccagaaggtactgaaatggtaatgcctggtgataacgttactatcgacgttgaattgatccacccaatcgccgttgaacaaggtactactttctctatccgtgaaggtggacgtactgttggttcaggtatggttacagaaatcgaagcttaattcgattgagttcccagaaataacaattatagtcagacaacttaattgtaactctctactttcgggtagagagtttttctgtaagtattcataaaatgcacagaaattctttaatcttagctaagtttatgctataatgtaccttgtaaaataaatatagaagaggtaagtgaaatgtcacgtaaaccaatcattgccggtaactggaaaatgaacaaaaatcctcaagaagcacaagctttcgttgaggcaattgcaggaaaattgcctgcaggcgacaaaattgaagcagctatcgcagctccagctgtagatttgaacgctctcttatggttcgctaaagattctgaattgaaagttgctgctcaaaactgctactttgaagatgctggtgccttcactggtgaaacatctccaaaagtattggctgaaatgggtgttaactatgttgttatcggtcactcagagcgtcgtgattacttccacgaaactgatgaagatattaataaaaaagctcatgcaatcttccgtaacggtttgactccaatcatctgttgtggtgagtcacttgaaacttacgaagctggtaaagcagtagaatttgtaggtgctcaagtttctgcagctttgaaagacttgactgctgatcaagtagcatcacttgttattgcttatgagccaatctgggcaatcggtactggtaaatcagctactaaagatgatgcacaaaacatgtgtaaagctgttcgtgacgttgttgctgctgatttcggtcaagaagttgcagacaaagttcgcgttcaatacggtggttctgtaaacccatcaaacgttgctgaatacatggcatgtccagacgttgacggtgcgcttgttggtggtgcatcacttgaagcagaaagcttcttggctttgttgaacttctaataacaaaaagcatcggattttgaattcgatgcttttttgatattttaagaggctacttcagtacccattctctaaaagcgtgggctacaccgctctcatcatttgatttcgtaatgtatttggcgattttcttcaattcaggatttccgttttccatgacaacaggattaccaacaacttccaacattggacggtcattttcttggtcaccgatggccatggtttgatccatagttagtccaagcttctcagctagatgaatgatagcttgtcccttgttaacagttttaggggtgatttccaaataaaatggtgctgattttgctacgttgtacttctcagtcaagatggtcggtagaagtggaatagcagcatcaagaatttctggctcatcaaccatcattgttttgatgatttccttgtcagccatttcttcaggagtgcgatagaaaatgggtgcacttactagtgtggattcgtaaatggtgtatttaccgatgttacggttggcagtatagataccttccttggtgctggcatgcattgggagcttgagtttacgggcagcagattcgatgtcgagataatcctcataagtcaaggtatctttgacaatatcctcaccagttgctgcatcttggactaagccaccgttaaaagtgatgacgtagtcacctgcttctgtaagattgagttcttctaaaattgcttgaacaccggaaatggggcgaccagtagcaataacaattttaacgcctgctttttttgcttcttggattgttgagtgtacttcagctgtaatttggtgttgactatttagtagtgtaccatcaatatcgatggcgacaagtttaatgctcatttgattctccaattataaaatgatcgttatgtatgtggctgttaaaatcagctatttgaggtgcgaaaattcctgtttcttctaacatttcttttgggaaatagaagcggctatcgccatggattgtgcctgataaggaatggacaattggtgatagagaggatagttctaccaaggtttcatctttgcgataaatctcaatttgagtccgtttcttttctgcattcggtcggtaaatgtcatacggcaaatcaaagttgtggtgaatagcagtatagtattctgggtcaaacccgacgtctgcgaccaggctacgcaggcggtccaaagcttcctcttcttcggccttgaaagtgatggatttgagcactttcctattgatatagcgctgggctaagtcagataatatacgatctggtccatctatccatgattgaaagtaagtattcataactccatcatccagactgaggtagtcggttagacggatacgatgctcaaaaaaaggtaatagccgaggtgaagttcgtgcaaaaaactcctgttcaccagtatatagtagtttggcacgattgagtaaattctgcaataggacttccatagagcggcttgctggatgaaaatagacttgcatgtacatctggtagcggctgagaacgtagtcttctactgcatgcataccagattctttgaaggcaattccattttctgtcgggcgaatgacacgtaatatcctagttaggtcaaattcaccatagttcgcacctgtgaagtaggaatctcgtaatagataatccatccggtcaacatcaatctggctcgaaatgagttgaacgacctgtttatttggataggtgtgtttgataacactagcaaccttgtctggaaactcaggtgaaacttgtttcaacagagcattgatttccgtttctggactagtaataatagcacaggtcatttcctcatggtctgtatcaaatagacgctcgaaggtatgagaataggctccgtgtccgacatcatggagtagcgcagcaaccatggtcagtagggactcatttgtatcccagatttgtggatacttgtcttcaaatttttgagtaatccgtctggcgatttcgtaggcgccaaggcagtgcgaaaagcggctatgctcgccaccatggaaggtataggaagtagtccctagttgcttgatgcggcgtagtcgctgaaattcttttgtattgataagtttataaatcagctcatgatcaacatgtacatagttatgaactggatcgcgaaatactttttctatcatagtttcattataacaaaaaagggagataaattcctgatttttctaaaacacaaggatattgctatgtacccaatggaatcttttggtataatggagaaatgaataatcaaattatcttattaactattcaggtctttattgtagccctgattctttggatgctttacacaattctatcctatgctaaaaagcacgatatttctctaaaagagaaattttggacaggatttggtatcggttatgttactgatttgctagacaccttggggattggaacctttgcaacgacaaccactatgtttaaactgacaaagttggtggaagacgatcgtaaaattcctgcgaccatgacaacggcgcacatcataccagtcttagtagaggcgctattgtttattacgatagttgaggttgatatggtcactctgattgctatggcagcagcggcatttacgggtgcctttgttggtgccaaggtaactcaaaaatgggatacaaagaaagttcaacgaattcttgggattttactaattattgcagcctgtttcatggtctatcgcatgattactaaccctggcgcagatcttaccaatgaagtaaagggcttaactggttggaaactggctgttggtattgcctttgattttatggtgggaatgctgatgagtatgggactgggtaactatgctcctgagttaattttcttctcattgatgggaattagtccagcggttgctcttccagttatgatgttgaatgctgctatgattatgacagctggtgccaagcagtttatccaatcaggacgagtaaactggccaggagttccaggaatcgttgtcggtggggtgctaggtgttttgacagccgctttcttcctatcaaatttggatattaataatttgaaaattttagttgtcttcattgcagcgtatacaggttttactctgcttcgttcatcctttgttactaggattaaaaaatagtaggaggaactatggatattcatttacgaaatgaaattgatctggacgggcagattgaggtagtggatcagcaatttcaagtggaagttaaggaaaaagatgggaatctctatctcatttatagtaacgatgaagctgaaaaagttgtcataaaatgtgacgaagaagagttagtgatgacacgcttttccactccgaagtctattatgcgattcatttctggtaaagaagctattgtgaccattcctacaccgttaggaatccagcattttgtgaccgatacaaaacgttaccaattaaaccgttcggatcaaagtgtccagttgcaatatgaattaaagggattggagaaccagcagctttttgcttcctatgatttggaaatctcgtggaaataatggtaaattctcaaagtaagttctagttcccgtccttccagaagttactctgagaaaactgcataacatcaacagaatttagtctcagactaagttctgtttttgactaaaaatgttgataatagtgagttttagggttgaaaatgttgaaaaaagagtacactaaagttactggctctgagacgtctcaaagtaagttctagctatctggaattttggatggaacaagttcctttctattttgaaattattttttgataaaaactagcgattacttatccaataatcgaggtgattgaatgacgttctcagggtcaattttagagattcccaaaagtgttgccaattcctcaccgtaggtaaatgtaaagagttcataggctgattttccgttgaaagaagctcgtttgacgctgttgatatgcgaacaaaccaggttgatgtcctcctgtgtcaagttgtcaaaagaacttcttttaggaagaatatctctgataagtgtgtgattcttctcaattctccccttctggtcagaacgattggggtcacagaagaatagcttagattctccgcgaacatccatttcgatatcgtccactctagcgaattcaccgccattatcggtcagaatgacaggaaatatttcgcaaaagtccatctctttctgatgcaggtcattcttgatagcgtagagatgtttagcgacctcattagctgttttattatcaagtaattgagcgaagataaagttacagaaggagaggttaaaggtgagaagtacctttccgccgatccgtccagtaacggtgtccatttccagccaatagctgattcctttctctgtgagaaagcgttggaagtcctcgtaagaccgtccttctttggcgattttaggaatgggttgtaggtttctgattctccgctttctgaatttcacgacacgggggaaatcaatgggctttgtggacagatagcctttttcaaggtatcggtagatagaagctctggatgccgacatttcgtttgaggcgatgatgtggttgaggtgttgtcccttttggatggcagcagaaacaatctcatccatgcgatagaattcttccttgtttagtgcaacacctgttctcgaatctgagagcttaacttcataatcaagctgagctctttttgcgtagtagaactgtttctggtatccgcagttgcttctctttttcggacaggcattacaaacgtaaggagtctttttgagtagagggcaggcctcacaattggaggtactagagttctcttttatcaccctatttctccgaacttcttttgaaattgtggacggatcttttcctaacttagctgctatagctgagaagggcttaagttgttcaattcctatttgaatatcattgcgatcagagagagttaagtgtttgtttttcattgtcagttaccaacttgtcccatagtaagttctaccttatttctttgtctcagtctaatttccagtttttaagacagactagaacttactttgggaatttactaaacaaatgaaagttcaggttttatggtaaaattcttgtttttcttcaaaaatatgatatgatagttaacaatataccagacggaggttgtgttaatagtgttgaatgtaaatgaattggtcaaaacagaattgcattgtcatttggatggctcattgtccctcggagtcattcgacaattggcacagatggctaaaatcactattcctgcagaagatgaagcattaagaaaattagttagtgttcatggaaaagttgatagtttaatggcttatttaaagttatttgattttgttcgcccactcttacaaactgcaacagctttagaattggcagcctatgatcttgtacgacaagttgcaagtgataaggtcatttacattgaggttcgttttgcaccagaactgtcgacggatcaagacttgactattttagaagcggtctcagcagttttagttggactaaacagggggcaggaagattttggagtggttgctaaacttctggtttgtggtttaaagcaaacgaatacgaatcaaacgaaggaactctttttggctattgctgatttggcaccaaaaggacttgtgggatttgatttcgcaggaaatgaagcagactatcctacggaagaacttcgggatattattcaatttactcagtctttaggttatcccatgactttccatgccggagaatgtggatgtgtgaccaatgtgattcaagctcttgaacttgggattagaaggattggtcatggcacagcacttactcgcaatcctgaagctatccaagcttttgtcaatagcggagcaacacttgaaatgtgcctaacatcgaatcttcaaactggtgcagctgattcgattgaatattttccatatcgtgagctagttgaggcaggagcaaacatcacaatcaacacagataatcgtaccgtttctaatactacacttaatagagaatatcagttatttgtagaatattttgggactagcaaagctgatttttaccgcttcaatcaaaatgctattcaggcaagttttgccagcgaagaagaaaagaaagttttgttggaactcctagaccaacagtattaagaaaaaagctctataccggtcgattagaccagtaaagagctttttactgtagatttaatttctttgtcataatgaagtgggttccaaagtagtaagcaaaagctaggataatattgactaatgctaagactggacttggatagagagaaaatggtgtagaataagctgttcctaggttacttaggacaaagaaagtgctaaatactccagtaacgatgagaatgccgatataagtcaagattgcaaagaggaagcgatgatccttgaataattgaccgacagatatagagaagtagatcaaaaggataccagtggtaatttcaattaaataatagacaatctgactgaatagaattgtccagtcgatagcttgaacaaaagtttgtatttctggcataatagcttcttcgcttgctgctagaatgactgcaaggatgattccaattgaaagtaagcaagtaatacctgccaagatataccaaacaatagaggcaagtagtttgcttaagataatctgatggctagataccggcagggtcatagtgagataaccttgtcggccataaacattttttctaaaacggttgattactagaacaaatgttgacaagaagagtgcggcaattaaaataccaaaagtcataaaggatgttcccaataagaccatctctccaccgccaggttcagtatttccagcctgtgtacggagggccaacgcttgtagccaaaaaccaagtactgctgataggaccacagctgcaatataaattcccaaataccatttacctacggattgaaattcgtatttcaataattttttaaacatagcaatctccttctaactaagccttaaaatcttggcggaagagttcgtcaatagattctccgctttcaattcgcaagtcatctacattcccatggcgaataacgcttccgtagtgtaggaaaataacctcgtccaaaatttgctcaacatctgaaattaagtgagtagagataataacagaggcagtcggagaatagttgttgacgatggtttttaaaatgtagtctcgggcggcagggtcaacaccaccaattggctcatctaaaacatacagctgtgcttgacggctcatcaccagaatgagctggactttttccttattccccttggagagatgtttcatacgactgtttaaatcaatacccaaatcttgtaaaagatggagagcacgctccttatcaaaatcagcgtaaaaatcttcaaaaaatgtaactgcttcgagcactttcatatgttcatcaagataagtggtatctgggagataagatacaatcgccttggtttctggcgatggtgtgcgaccattgatcaatacttgaccatattctggctgcaacaggccgttgatcaatttaatcatggttgttttacccgaaccatttggtcccaaaagtcctatgatttttccggcagctaacttcaaattaacattatttagggcgacagctccaccataagattttgaaacttgctgtagctcaaccaaagtatatgcgttactcataagtaactcctttcaaataatcatctaactggctagtgagttcatcgtgtctaaagcccaattctaacatattgttcacgaagttctccagttccttttgggctaaatgtaggcgagtttgtgtaatcaattcttgattatctgttacaaaacgacctgttgtgcgaaccgagtaaacaaatccttctgtttctaaatcagacaaagcgcgctgaacggtatttggattgacgccagcaatttcagctaagtcacgaacagtgggaagtttatctccagattttaattgattagtcacaatctgcaatttaatagtattgctgatttgaatatagatggggatgttattatcaaatttccaagccataatcatttcctttctaggatgacaccgtgtttatgtcttatcttaataatacaataaactatataaattagcaagaaaaatgttttgaatttttaaaaaatatttttggataaatatttgatataatagaagaaacatgaaaaggagaataccatgctggcacaattagatacaaagacagtttatacctttatggatagcatggtgacgatagagagttatgtaggcagggctaaagagcttggttaccacgcattggggataatggataaaaacagtctttatgcagcctatagttttatggaatcctgtaacaaaatggggcttcaaccaattattggttgtgaactggactggaaattacagggagaggagcaggacatcactactcaattgattgctctgacaaccagaggttatcgcaatctattgaaaatttcgactgctaagatgacagggcaagatgattttgaaactattcgtcaatatttagtcgacatagcagtggttgttccttatttttctggcattgagcaccttgagttgggtgtaaactattatatcggagtgacagttgacacaccggttcaagattttaagcaagcaccccttccaatccatactgttcgtttttttgaagaggaacaattggaaagtctacaggttctccatgctattcgagataatattccgcttaatcaggtttcagatgtagatagtcggcaaaagcttttatcggctgatagcttaaccaatctattttctaatcggtttccgcaagcagttgataatttacgtgacttggttgcagggatttcttatcaattaaatacagatttaaaattgccgcgttttaatcgtgacagacctgcagtggaagaattatacgagcgctcctatcaaggattagaagagaagggcttgactaattcactgtataaggaacgcttggaaaaggaattatccattattcatcaaatggaatttgatgattatttcttgattgtatgggacctacttcgttttggacgtagccaagggtactacatgggaatggggcgcggttcagctgttggaagcctagttgcctacgccttaaatatcacaggtattgatcctgttaagcataatcttctctttgaacgctttctcaatgctgaacgttattcaatgcccgatattgatattgatattccagatattcatcgagcagattttattcgttatgtacgagatcgttatggttcaacccatgctgctcaaattgtaacctactcgacatttggagctaagcaggctattcgtgatgtatttaagcgtttcggaacacctgaatatgagttaagtaatattaccaagaaaatttcatttagagatagtcttacttctgcctatcagcgaaatgccgcttttcgccagattatcaatagtaagatagagtaccaaaaagcttttgcgattgctcaacaaattgaagggcaaccccgacagacttctatccatgcagcagggatagtgatgagtgatgaggagttgacagataccatccctcttaaaataggggatgacatgctggtaacccaatatgatgcacatgctgttgaggcgaatggtctgttgaaaatggatttccttggcttacgaaatctgacctttgtgcaaaaaatggcagaaggagtacgtgaacgttatcagcaggaaattgatattgccaagatagatttagaagacaagaaaaccttggaactttttgctgctggtcggactaagggaatttttcaatttgaacagcctggtgcgattagcctgcttcgaagggtcaaacctggtcgatttgaagatatagttgcaacaacgagtttgaatagaccgggggctagtgattattcggataactttgtaaaacgcaaacatggacaagagacagttgatttgttggatccaaccattgctcctattttacaaccgacttatggtatcatgctttatcaggaacaggtcatgcagattgcacaggtctatgcaggctttacgcttggcaaggcggatttactccgcagggcgatgtctaaaaagaatgcgcaggaaatgcaggcaatggaagcggaatttttacagggagcactgaaaaacggacatgctgaagagaatgcaagggaaatatttggcatgatggctaagttcgctggttatggttttaaccgtagccacgcctatgcttattcagccttagcctttcaaatggcctatttcaagagtcactatacggatgtcttttttgatgtcatgctcaatcattctagcagtgcttatattgaagatgcgatgcagtttgactttgaggtagctcgactcacgattaacaatattccttatcacgataagtttgataaaagtaaggtttacctaggattaaaaacactgaaaggtttgcctaaagatttagctttatggatattggatcatcgtccctataagtctgtagaagattttattttgcgcttgccagataatttcaagaaaaaggatttactaatccctcttattcagattggtttatttgatgattttgacgccaatcgaaaaaagattattgaaaatctagacaatctctttgtctttgcagaggcaattggtacattttttgcagaggagagttatagttggacagatgtagaagattacagcgacagtgaaaaatttatgctagagcaagaattgctaggtgttggtattagtccgcatcctttagtcaatatttgtcgagagtctaagcgtagttttacagatttggctgatttagcggttggcaatcgagcgaccgttcttgtgcagattcaagctattcgattgattcgtaccaaaaagactggggagcagatggcatttcttcgagtgacagataccaagaggacgcttgacgtgactcttttccccgaatcttatcgccaatacgcttctattttggaagaagggggaatggggtacatcacaggtagagtgcaagagcgggatggacagttgcaattagttctagaaaaattagagcctgtcagtttagagaaattttggattcttttggaaaatcgagaacacgattatgctgttgctcgtattttggataaatatagaggaagcattccagtagtacttcattatcaagatagtaatcagacaattcaggctgagcaccacatggttatgaaaacgcctcaattagaagaagagttaagtgaatttgttatgaaaacgatttttcgataaaaaaatagcaaaaagtcaagcaagtttaggctaagtatgttataatagggcagttaaaatgaaaagttaaaggagcattaacgaatgaaacgtattgctgttttgaccagtggtggtgatgcccctggtatgaacgctgctattcgtgcagttgttcgccaagcaatttcagaaggaatggaagtttatggaatcaacgaaggttacgcaggtatggttgcgggtgatatccatgaattgtctgcacgttctgtaggtgatattatttcacgtggaggaacattcctttgttcagctcgttatccagaatttgccaaattagaagggcaacttaaagggattgagcaattgaaaaaacatggtatcgaaggtgtagttgttatcggtggtgatggttcttaccacggtgcaatgcgcttgacggagcatggtttcccagctattggtgtacctggtacaattgataacgacatcgtgggtacagattttacaatcggttttgatacagctgtaacaactgctatggatgcgattgataaaatccgcgatacttcatcaagtcaccgtcgtactttcgttgttgaagtaatgggacgtcatgcgggagacatcgctctttgggctggtattgcttctggtgcagatgttatcgttgttccagaagaagacttcaatatcaacgatgttgttgatcgcattaaagcgggctacgataaaggtaagaaacatagcatcattgtcttggccgaaggtgttatgccagcggcacagtttgctgaagaattgaaagcagcaggcgatacaagtgatcttcgtgtgacagaacttggtcatatccaacgtggtggttctccaacagcgcgtgatcgtgtactcgcttctcgtatgggtgctcatgccgttaaattgcttaaagaaggccgtggaggtcttgcggtaggtatccgtaacgagcaaatggttgaaaatccaattcttggaactgcagaagaaggtgccttgtttagcttgactactgatggcaagattgtagttaataatccgcataaagcagatttggagttggctgatttgaaccgtaacttgtcaatctaggtatcattgtttaaaagtgttaattaagggtcatatgaccattgaaataaaaggagttttgttaagatgaacaaacgtgttaaaattgttgcaacccttggtccagcggtagaaatccgcggtggtaaaaaattcggtgacgatggttactggggtgaaaaattagatgttgagtcatcagcacagaaaatcgctgctttgattacagaaggtgccaatgttttccgtttcaacttctcacacggtgaccaccaagagcaaggtgatcgtatggcaacagttcgtcgtgcagaagaaatcgctggtaaaaaagtaggtttcttgttggatacaaaaggtccagaaatccgtacagaattgtttgaagatgatgcaaaagaatacgcatatacaactggtgacaaattgcgtgttgctacaaaacaaggtatcaaatctacaaaagaagtgattgctttgaacgtagcaggtggtttggatgtctttgacgatgttgaagttggtaagcaaatccttgttgacgatggtaaacttggtttgacagttgttgaaaaagatgcagtaaaccgtgaatttgttgttttggttgaaaacgacggtgtaattgctaaacaaaaaggtgtaaacatcccttacacaaaaattcctttcccagctcttgcagagcgtgataatgcagatatccgcttcggtcttgagcaaggtttgaactttattgctatctcatttgtacgtactgcaaaagacgtagaagttgttcgtaatatctgtaaagaaactggtaacgaccacgttcaattgtttgcgaaaatcgaaaaccaacaaggtatcgacaacatcgacgaaatcatcgaagcagcagatggtatcatgattgctcgtggtgacatgggtatcgaagtaccattcgaaatggttccagtttaccaaaaaatgattatcactaaagtgaatgcagctggtaaagcagttatcacagcaacaaacatgttggaaacaatgactgaaaaaccacgtgcaactcgttctgaagtatctgacgtattcaatgctgttatcgacggtactgatgcaacaatgctttcaggcgagtctgcaaacggtaaatatccagtagaatcagttcgtacaatggcaactatcgctaaaaacgcacagactcttcttaatgaatatggtcgtttgaactctgatcagtttaatcgtgcctctaaaacagaagttattgcttctgcagtaaaagacgcatgtcactcaatggacatcaaactagttgtaacagttacagaaacaggttactcagctcgttcgatctctaaataccgtccagatgcggacatcttggcagtaacatttactgagaaagtacaaaaatcattgatgcttaactggggtgttattccaattgtaacaaaccgtccagattcaactgacgatatgtttgatttggctgaacgtattgccaaagagcaaggtcttgttgaagcaggagatgacattattatcgttgctggtgtgcctgtaggtgttgcaggttcaacaaatactatgcgtgttcgtacagtaaaataataaaaaggtccgcttggacctttttgtagtaattagagaataagttaaatacgtgctgttatagattttttgcctctaaatgattttgggatgttgatataaaaaataaataagagtaagaataacttgttcaaagaatataaatataaacggaggaaagatgaacattcaagaacgattttctttgagaaaatccgcggttggcttggtctcagtctctttgctatgtgctatttatacatccactgttgctgccgatacagttgttacaggagtgaatgaaataattgaagaatcacaagtcaaggatgaggtatctattgaatcagaaaaaaatgaatccctagatggttctaatattgaaattgtagaggaaatagcagacaacatcccatcacctgttatcgctgaaggggaagtagcggtagagatgaaagttgacagagggaccgagaatgtagtttctagaaatgatacagaagttacgacgagcgagcaaaatcagatagaggttactgagacaaaagaaattttgaatcagaccagttatcaaacggagagtggcgagcaacgacaaattatatgggcccatggaattactcctcctgcaatggaacaaagcggtggttttgtaaaggaaaagtatggagactatttaaactatacagcgccatttgaggctggaaaaggctactatgataccaataagagtctgaatgcttcatttattgaccttaatctttgttttgcagctgtgtcttcaaacatggtacattggtggttggaacagaatagttcctatgttgagcgatatctcaaagaaaaaaagggtacagtaaatgttgaagaaaactacgcaataacggacttacggcgctatattaattcattccaaaatcaacaaaatagtcgagtttttgatatgttcaaaacttactatggttatcgtacaaatggttttgtatcagatgccttggttgacttgtttattaacggatataaacctaaggcacagggcggtgtcaatctggaagatagccagttagtaccagatagtaggggtggctttttctacgacgttttcaaagagaaaaaactgacaaatcgaatttttagtggtagttatgagcggtttggtgaggatgttcgaactgttttggaaagcaaaggattactcggcttaacttatagaacattaggttatgcaacgcatattgtgacggtatggggtgctgagtacgacaatcaaggtaagattaaggctgtctatatcacagattctgatgatcaacaagaacaaattggtttgaagcgtatgggaatcactcgtgatgcttccggaaatccacgtttgaataatcatatgaaaaataattcagctggagcgcttttggattatgtccatacaatccgtctgggtcaagacttatgggaagaatatttcaatccgcttgcaaaagccaaagaaacagctagtcagacattagccgatacaaagaaggcgttggatttgtctattcaaggacaatctgaattgccagaatcaatgcgactgatttatcttgaaaaactaaataatctctataatcaaggaattctatctattcaaaaggcagaaagttctgagatgctaagtggtgcattggaaaatggtttaaatagtttaaagagtttagattttcctatttcagaagttggaaatgctttggcaccagatttaccagtaggtgatcgctcaacggtttcagatgttgattctctatcatctcaagaaacaagttccacaaatttggaagcagacacagagaatgcaggtattattgcagatggtaccaatcaattgcattttccagtggaggcccaaacgacatcttcagtagaggctgagggagataatgtttttgaacaagaggcagatacattaccaataattattgaaaacaaggatgaatttggttcagaactatcaagaaacatgcaaacgtcagaaacggattcgctagtagtagctgttgaagaagatgtgaaaaatgatgaggtagcccaagttgaagagcttcttgaatcagaaaaagttgaaaatcagagttcggaacttctgtcagacaccctaatcgtagagagtgcaaatgacaaagaagaagatagagtggaggcggttgtttctgaacaaccagactcaataccacatcaaaatgtagaaatctctcttgtagaaccaacgaatgtcgaaactgaaactgtggtcactcctattaatgatgcagctactcctcatggttccccgacgtatatagataattccgtaactgaatctgtagctactccacttgaaaaagactccattcaagccggggagacagagattgcagaaccaacctcgagcgaatcaacgaatgtcgaaactgaaactgtggtcactcctgttaatgatgtagctactcctcatggttccccgacgtatatagataattccgtaactgaatctgtagctactccacttgaaaaagactccattcaagccggagagacagaaattgcagaaccaacctcgagcgaatcaacgaatgtcgaaactgaaactgtggtcactcctgttaatgatgtagctactcctcatggttccccgacgtatatagataattccgtaactgaatctgtagctactccacttgaaaaagactccattcaagccggggagacagagattgcagaaccaacctcgagcgaatcaactagtgttgaagctgaacttgtcgacaattctgaaattcatgcagctacctcttcagttactccctgtggctcctcggcatatgcagatggttccacaactgaatctgtagccactccgcttgaaaaagactccattcagactggaaatacagaaattgcagaaccaacctcgagcaaatcaactaatgtagaagctgcatctgtcgacaattctgaaattcatgcagatgcctctctaactgctgtttcatcagttaatctggataatccagtgattgaaccagtagctatctcccttatcggttctaagagggacacgaatgcagaagtagaagtttcttcattatcgaaaagagaggttagaaaaacaaatactgacgggctaatctctgttcaatcaaaagttattaagaaagaattgctagaatcaagcttagcagaagcagggtctccattgctagaagccaccattgctcagtcttcaaactcaaatagtactgagataggtatgagctatcagaatactgtgttattagagtctaataatacagagcgtcaggtgtctaaagcagaaattgttatggaacacaaggagacagagttagttgaaacggtttcatctgcttctgagcctgtagtgctcgtagaaaatatctcacaaacctcaaataatactattgaatctggtaagaatatgggagttcaatctcaagcaggtgcaaaacaaattttaggcgtagaacaatcttcgaaagtaagtacacctacttcaagacagattatgggagtcggtctattgactcttgttcttggtagtgctttaggtttgttaaagaaaagacgtaagtaaaagaagtatcgtcatttagtttttcttttattacttcgttaactcgccttacctaactccagttatgcctgcggctcgttgcctagtactaaaagtaaactaaaagactatattttcaacgaattaggtttttaagtgaatcagtttctatggttgcgataacatgctatagataatcctttaatagtttgagactagaatggtagtattctagatagaaataagcaacgaggttccccgttgcttattgtatttattggttagataacaactagtcttagtatctacatttaaagggttagtagaatctaaacgtatcgtatcttattttttgagaatatatctatttggagaatatggtgtacggtcaaagtttgtttcttgattgagaatttctttagcaatttgccaaccgataattggaccgtttgtcagaccggtggagcctagaccactagctacccagacattaggcatatcctcaatatttccgtagaatggtgaataagttgaagtataggcgcgcgttccaatgcgagttctggttacaggatagtttgccaaatcaggcatgaattcagctattttatcatgcatggcttggattttttcagggtctagttctaaatcgtagcccatgtcatcttcatgagttgcaccaataatgattttcccattttcaaatggtaggatatcaatctctccgtaaggcatacaaactggccaattgtcggtatcgaattctgtatctaattcgaacaattgtcctttttgtggtcgaacatccacttgatagccaagaggttcaagaatatgtggtaaccaggcccctgtggctaagataatatggtcagcagtaagcacttgattatctacttcgacagtatggttgtcgagcagttttgcctgtccgtagatacgtgtaccaccatttttcaaaaattgttcctgaagaatatcaatcaaacgcccaccatcaatacgaccgccaccttctaaatggataccaaaatagtctggcttaagtagtggcaggtactggttaatttccgagcctataagcggagtaatttcgccaatagtcggagtatctacgcgacgttcctcggcaattttttggattttatcaagtagttcaggcttactttttaggccgatggttccagtctgtttgaatggaatttcagtagcacccgatttttccaaatcggctaccaattgacggtagaaaacagcaccatcggaagtcagcttataccagtctttattttttttctgagccatccatgggccgatgatacctgcggcagctcgtgtggctgttccgacccctgaatcaatgagagtaagattgacttgttcttcttgggagagataaaaggctgcagtagagccaacaattcctccgcctataataataacttgttttttcataagttaattatatcacaaattcagaagtttatttatttttttcaacatgatacaatagaaaataagaaaaattgaggagttcgtgtgtcagatataatgtatcctgaggtcctaactgttggaagtggggccgtaaaagttgcaacagtcggagatagtttgacttatggatatggcttggagaatcgggaaaaagatgcctatccttgtattctagctgagaaacttgggcatcactatcaagtttcaaattatggattgagtgggcgttcacttcagtcaactgcagattttccttactttaaagagaagaatgcccaactttcacttgagagtgaagcagatattgtcatcatcatgattggtagtaacgatagccgaggaccatattggaatagggagaggtttattcaagagtatagggaaatggcagagcagtatatggatttaccaagccagccggatgtttatttagtcatcccgccttacgtaccaaccagtcgttttggattgaataatcaaattattgaagatgaattacaaaaaattatcccagctatcggaaacgaacttggtttaccagttattaacctttacactgtgacggagggacatcttgaatactatagcgatggtcttcatttgacaccgttaggaaatcaagttattgctgaagagatttaccagcatctcagacactaatggctctaaattgtggtataatactagtgaaatggagagattatggtaaaaagagatttaataaaacaaatcagtttattggtcttattgatttttggaatcattggcctacgattttggttacttgagccagtcacgattacccctgagatggcaaatagttatttgaaggaaaatgactttatcatgacagtgcgaaatgtccgcccgattcatggagattttattttgtataaccatgagggaaaagagtatgtgagtcgtgtgattgcattggaaaacgagacggttacctatatggacgatgttctctatcgtaatgatattattgttacagagaactatttaaaaacgcctcattcacaagaaagttatacagatgactttacattggaaaccttgacaaatggaaagtacaacatcattccagagggacactatttggtgttgaatgatgtacgaacgaatcaacaggatagtcgtagttttggtttgatttctagtgaggctattgttggtagactgacttttcggattagtccactttcagaatttggttttattaagacagggctggttcagtagaatcagctttttttattgtattgagatggctggaactgtattttgaaattagactagaccaattaaaatgttgacaaggatgaaatcttgttatatactgatttcactggtctttttagatataaattagactagaccaatttttaaagaaatgaaagccgatgttaacaaacatcgtaggtgatatgtatgtgtggaatcgttggtgttgtaggaaatacaaacgcaactgatattttgattcaaggacttgaaaaattagaataccgtggttatgattcagcaggtatttttgtgacgggtggtgagcaagctcatcttgtgaaagctgttggtcgcattgcagaattgtctgcaaaagttggcgataagactgaagggacaacagggatcggtcatactcgttgggcgactcatggtaagccaactgagaacaatgctcaccctcacacttctcaaactgctggacatatcctagttcacaacggtgtgattgaaaactacgcagaaatcaaggaagagtatcttgcaggtcatgacttgaaagggcagacagatacagaaattgctgtacacttgattggtcaatttgcagaagaaggtttgtcaactctagaagcctttaaaaaagcattgaagattattcaaggttcatatgcctttgctttgattgatgctgcggatgcagatacaatctatgttgccaaaaataaatctccacttttgattggtcttggtgatggctataacatggtctgctcagatgccatggctatgattcgtgagacaagtgaatacatggaaattcacgataaggaattggttatcgtgaaaaaagatagtgttgaagtcatggactatgatggcaatgcgattgaacgtggtagttatacagctgagcttgatttgtcagatattggtaagggaacttatccatactacatgctcaaggaaattgatgagcagccaactgttatgcgtaaattgattagtgcctatacaaatgaagctggtcaggtaacagttgacgcggatattattaaggcagtacaagaagctgaccgtatctatatcttggctgctggaacttcctatcacgcaggatttgccgcaaaagacttcttggaaaaattgacagatacaccagtagagttgggaatttcatctgagtggggctacagtatgccacttttgagcaaaaagccactctttgtcatgattagccagtcaggtgaaactgctgatagccgtcaggtattggttaaagctaatgaaatgggcattccaagtttgactgtaaccaacgttcctggttcgaccctatcacgtgaggcaacttacaccatgttgctccatgcaggaccagaaattgcggtagcttctacaaaagcctacactgcacagattgcgactttggcaatcttggcgaaggctgtcggtgatgcaaatggcaatgcctacgcgaaagaatttgacttggtgcatgaattgtccatcgtagctcaatctattgaggccagcttgtcagaaaaagatgtgattgctgaaaaagttgaaaaactcttatcaaccactcgcaacgcattctatatcggtcgtggtagtgactactacgtttctatggaagccagcttgaaattgaaagaaatttcatacatccaatgtgaaggctttgcggcaggtgaattgaaacacggtaccatttcattgattgaagacggtgttcctgtcttggccttgatttcaaatcatccacatcttgcaagccatactcgaggcaatattcaggaagtggtggcgcgtggtgccaatgtcttgacaattgtagatgaagcagtagctaaggaagaggatgacatcactgttacaacggttcatccattcttatcagcgattgctatggttgttccgacacagttgatcgcttactatgcgacattgcaacgcggtttggatgttgataaaccacgtaacttggctaagtctgttactgttgaataagaagataaggttcggatttcggacctttttttcaaatcaatgaaaaaacatacaaaattttgttaaatttattaaaaattctgaaaaattctttgaaattaaggatattttttgatatactagaacctaataattcttttaggagagctctatggattatgttttggaagttctgcccagtctactaaatggtgctgcagtctccttgcaagtattttttctagtattgatattatccttgccattaggagctgttttcgcttttttaatgcagattaaatttaaacccttacaatggttattgcatttctatgtattaattatgcgaggaacccccttacttttacaattaatttttgtttattacgtcttaccaagtgtgggtattacatttgaccgaatgcctgctgtgattctggcctttacgctcaactatgcggcctatttctctgaaattttccgtggtggtattgaagctattccaaaaggtcagtatgaagctgctaaggtattgaaatttacccctgttcagaccattcgctacattgtcttaccacaggttgtgaaaattgttctgccaagtgttttcaatgaagtcatgactttggtaaaggatacttctttggtctatgcacttggggttagcgatttgttgttggctagtcgtactgcggccaatcgtgatgccagcttggcacctatgtttatcgcaggtgcaatctacctattgatgatcggtgcggtaacactgatttctaaacaagtagaaaagaaatttgattattatagataggaggaagtcatgttagagttacgcaatttgtcaaaacgctttgaagataaacagattttctccaactatgatttggtcattccagaagggaaaattgttgccattgttggtcaatctggcggtggtaagacaactcttttacggatgttggctggtttagagactattgattcaggaactttgatgtataacggtcaagaactgccattagaggagttgggaaaacgacatttgctgggctttgtcttccaggacttccagcttttcccgcacctatccgtattggaaaacttggttctctctcctatgaaaacgcaaaatatgttgcgttcagaggcggaagacaaggcccttaaactcttggatactcttggacttgctaaccacgcaaatgcctacccattttcattatcgggtggacagaaacaacgtgtggccttggcgcgtgcgatgatgattgatcctgagattatcggctatgatgaaccaacttcggccctagaccctgaattaagaaaagaagttgagaaactgattcttgaaaatagggctactggaatcacgcaaattgtggtcacccatgatatgcagtttgctgagaatatcgcagatgaaatcatcaaaattgaaccgaaacactaagaaaaggaacaaatatgatgatgaatattaaaaaaatgatgcttggagctcttgctcttgtaacttctttgactcttgctgcttgtggctccaatgattcggctactaagtctgataattggacagcctacgagtctgaaaaatccgttacgattggctttgataagacctttgtcccaatgggatttgaacagacagatggttcttacacaggttttgatattgacttggctaatgcagtctttgaaaaatatggaattactgtaaaatggcaaccaattgactgggacttgaaagaaactgaattgaataacgggaatattgatttaatttggaatggttattctattacagatgagcgtaaggaaaaagttcttttcacaaatccctacatggataaccaacaagttcttgtaaccaaaaaatcttccaatattagccaagtatctgatatgaaggataagattttaggtgcgcaagcaggttcatctggctattcagtatttgaatcacaaccagctattttgaaagatattgttcaaaataacgatgcaagtcagtatgcgaccttcaatgaagccttgattgacttgaaaaacgatcgtattgatggccttttgattgaccgtgtgtatgcaaattattacttgcaacaagagggaattatcgcagattacaacatcattgatgcaggttttgaaaatgaagccttcgcagtcggtgctcgtaaatcagatacgacactcgtggaaaacattaataaggcgtttgctgaattatataaagaaggtaaattccaagaaatctcccaaaaatggtttggtgaggatgttgcaaccgacacagtaaaaaaataataatgtaagcaaaagtgactgaacaagacatccatgatggttacaccctcatccacagaataatgaaaagaactcgtgaaaacggtggggtgtacaccaatatcattaacttaagattctacgaggctgagcaaaaagctcagcgccacttctcggagttcgtgtcaacatctcagcgcagtggttgattggcttaaacagtcactattctgactgttggagctatgcgggggtgggagtttaaaaggtctgggagaccttttaaagtgggagatataagctgacggcagtcagctcacataaattgatgtctggggatagattgtttcagctcaacaacttaaaacgaaaaattgttgacgaactttttttcgtctggtcgagttcttatacgaaaactcaaaagaatgcaaaaattcccttcctatgatataatcaaagtgaaaaaaatttgtatttaggctactagttcgtccctagtagtctttttttgtgctaaaaattcaggataagtcatctgttcttttaaaaggatataggctatttttaatagttgatgcgcaagtgcaatggttgctttttgtgagccacgccgactttgaatctgataatatcgttctgctaatgggctgcctttttgtcttttgacagcgaaggccgcttgacataagcatttcttccaataggaattcccgtgtcgaatcttggtacttcgtttttcccactccctaggattttttattatatgacttttagtccatcacaatccgtaaagtatgtgacaaatgaaccgaggatgggcaaaaaatggtcctataatttctgtagcgggtaaaaccactatggagccttttaaatgtaaaagtcatatgacctataatgaaaagcgaaaaaacttacattagaaagaggtcatatggaataaatcaagagttaggggagtgactcttgattcctgagcctagaaatagaaaagcgaagatcttatcacaaattttcttggaatagaagacaaaaatatcgctatcatgactgaatatgatgtggaaactcacttagattgtgtgtctccaaaatgtcttgcctgaaagggacaaatagtgaaatacaacttccaaagagcatctaaaatcctttgcttagaagcagctgataatcctctctccttatccatcttagaaagcgtcggttcaagtgtaaaggatgcgggaaaatggttgtcgctgaaattcacttattaaaaaaacgaccaaatctctgttgctattaaccagaaaaccccccaattactactcgttgagaatcaagcaatgagtaagcaatgttcacctgatactattgtcatcaaggatagcttttctatcctattcggaactataaagtaagagtttttgaagggggtagatattggttgcatgtattgaaaaacttgtggttccatggtttttaaagttactctatctggctatattttgaactatgttattacaccagtttctgattatgtagtgaattgcttgttggaaggctatcagtaatctgtgattttagcagatttagtcaggagtttaaagacaacttggaacagaaggatagaacatggaaggagttaattagtataacaaatggagattattagccatgaggcgaaccattgaaactcgttttctgaatcatacgctttgtttgatatagaacaaacctttgccagaggactgctcggattacagctacggattgaacaaatcctacttatctacaatctaagctattttgactttaactagtagcacgggtaaaaaaactgcctagttcaatcagaactgggcagtacttattttacattctaaaaaatggattgaaatttttctcatgtccaacgctggtattttgaccatgacctggatggacagtatagtgatttggcagggtaaagatatgttctctgatgccagtaatcaggtcatcaaagttgctggttggcaggtctgtgcgtcccacagtttcacggaaaagtgcgtctccagtgatgacacattcatcctctgggaagataaaggaaacaccaccaatagagtgaccaggtgttggaactaccttgaaatgaaaaccgtcaaactggtagtcttcttggtattggaagattttttcagcaggtcggcagactacattttccatatcatcatgacgaggtagacctgatagattcatctctggtgtgtagagccagctggcttcattttcagccacatagacaggcgggaaattgtaggtctcacgcaggatgtccaaactcataatatggtcatagtgagtgtgagtcaggagaatagccgaaattggttttccgattttttcgatagttacttgaatttttgtccagtcactcccagggtcaatgataatcagatgggtatcattttcaaggtagtaggtattttgaaaagcgacaggattgacagatttgtgaataatcattctttttccttcttctaacagttactgatgttactagtctaacaaaaaaacacgccttcttcatggaatttgtttggagctttttccatgagagggaatatgctataatgaacagtatgaaagacacaagaacaagcaatcggtatgccgttgtagatttggaagcaactggtacaggtaccgatgcaaaaatcattcaaatcgggattgttctcgttgaaaatggagaaatcattgacagttatgcaacggatatcaatccctatgagctactggatgaccatatcaagaatctgacaggtatcacagaccaacagctaagtcaggctccagattttggtcaggtagcaagtaccatttacgacatgattggagatgctatttttgtagcccataatgtcaaatttgatgctaatctcttggcagaagcactcttttttgaaggttatgaactgttgacaccgcgtgtagatacggtagaattatcacagctatttttcccgacttttgaaaaatatagcttgggaaaccttgcagagcatttggaacttggtttggaccaggcacacacggccatatcagatgccatggctacggcgcgcttgctcatcaaaattcaagagaaaataaagagcttacccaggtctattgttgaaaagattcttgatttggcggacaatctgctctttgaatcccgtttggtcattgatgagatggtgcctgttctgtcagaaaatctatcatacgatttagaatctattcatgacttggtcttgaaaaagccagaagaaatcaagtcagcctaccgattatctgaagatttttcgaccaatattgcccttctcggcttgcatgaacgaaaaaaacaaactgcttttgctcaagtagtagaaaaacgcttggttgacgaagaaaaagtgcattttattcaagcgcaggcaggtttggggaagacttacggttatctcttgcctttacttgctaagtcagaccagcctttattggtcaccgtaccgaccaagctccttcaagagcagattatggaaaaggaagggagcaagcttaaagagatatttcgtattcccatagtctctctaaaatcacccaagcattttatcaagttagacaactactggaaaaccctgcagaggcaggatgataatcgcctggtcaatcaattcaaaatgcaggtgcttgtctggttatgcgaaaccacgacaggtgatttggatgagcttaagcaaaaacaacgctatcaagcttactttgatgagattgcccacgatgggaaattggagcctgaaagtcttttttggggcttggatttttggcaacgattgaaccaacaagctctctctagtagactgctcattaccaaccacgcttattttctcagccatcttaaggaccaagatcctcacatggataagcgtatggtggtgattgatgaagcacaaaagtttctcttggctgctgaaaatctagcgacggcttcgcaagatttgacaagtatgttacaagtattgcaaagtaaaaaggatagagcgacggctattttggaccaacgtttgtatgagtcttgccagtttgaactcaaccactttttgagtcgttttcgtcagcatggtcaacgagaggttcaaaaggctgaacttcaccaacttggtcagaacctggaggagcttggagatgttgatttgaacgacttgcatcagctcatagactattacgataccttttggttggaggagaaaaatttagaagaaaagcggcttgcctatttgcggagctccaaggatagcctcctaaatgcgaccaactatctgccagatactaagattttctgcatcagcgccaccttgaccatcagcaaaaaggtcagtctggcggatctgctgggctttgagcaggtcaccttggatttgataccgactcaaactgtgaccaaccagcggctactttttccgacccatctccccgacatcctcgcttggaccaaggaggagcatgcagcatatttggctactactttaggagagatagcagagctgggacgaccgattttggtcttgtttacatcgatttctatgctcttgcaggtgtcggatttgttagaagacaataacattccccacctagcccagcacaagcatggacaggaaatgactctcaaacgcaaatttgaacgaggggaatgccaaattttactcggcacaggtgtattctgggagggcgttgactttgccagtcagaatcaattgattcaggttattacaaggctcccatttgacaatccaaaggaccggtttgtacaaaaaatcaatcaccatctgcgtgaagaagggaaaaatccattttatgattacagcctgcctatgatgatgattaagctcaaacaagccatcggtcgtaccaatcgccatgacaaacaagattcactagtcttggttttggacccgcgtgttcacaccaaacgctatggacagcaaattctgtccttctttgagaaagattatttaatgttaagtgtggatgcgaaagaaatagaaggagctattcaagatttttttgaataagttgaaagggagccacaaggcttccttttgtttccagcgttttttaatgcactcatgattaggaatctattccctctctccttgccgaataacagtgattttctttatgattaaaatatggtataattttccaaatattagtttttgtgagaagagattatgacagaaaaaacaattgtatttaaggtcgggacaagttctctgacgcaagaaaatggcagtctggaccgtatcaagatcgctcggattaccaatcagctggctcagttgcaccagaaaggttaccagattgtgctggtgacgtcgggctcgattgctgctggttttcggagattgggatttgacaagcgaccgaccaagattgcggagaagcaggcttctgcggccgttggacaaggtttgctgattgaggaatatacgcaaaatctaatgaaggacggcatcgtatcggctcagattttactgacccaggatgattttgcggatgccagacgttatcagaatgcctctcaagccttgcaggtcttgctcaagcaacgggctattcctattataaatgaaaatgataccattgccattgaggagattaaggtgggggataacgatactttatctgctcaggtggcttctctcttgaaagcagacctattggtgctcttgacggatgtggatggactttacactgccaatcctaacagcgatccgactgcccagcacttgcctcaaattaaggagattacggaagatttatttgccatggcagcaggagcaggctcgtccaatggaacaggtggcatgaccaccaaattgcaggcggcccagattgcgaccaagtcaggcgtgcccgtctttatctgctcttcaaaagaggataccgccctcttgcaggcggtcacccaagccaatcgtggaacgctctttttagcagatgaccatgccatgaaccaacgcaagcagtggatggccttctatgctcggacagacgcggcggttgaagtggatgcaggagcggttgatgctatgttgcaccagggccgcagtttgttagctactggtgtcaaagccctcgaaggagactttgaagtgggccaggtcgtagaagtttacagccaagcagaccatcgtttgattggtaaaggtcgggtcaaactgtcctccaaggacttgcaggaccagttggcaaatggcagagcagagggcgtgttgattcaccgcaacgattgggtgagcttatagttgttcagtttgtctcgattatgttgacgaacgagtaaactgaaagactaaataggagaaatttatgacaacaacacaagtattattagatagtttattggccaacaaggcttctatcaacctagcgacaacagaacagaaaaaccaggctctatcagcaatggcagaccagttggttgctcagactgaggcaattttagcaggcaatgccatcgacatggaacatgcccaaggcaagattagccaggtgatgcaggaccgtttgctgctgacagaggaacggattgaagctatggcagatggcattcgtgccttgattggcttgccagatcctgtcggattagtcttggaagaatccactcgggcagacggcttgaacatttgcaagaaatccattccctttggtttggtgggaatgatttacgaaagccgaccaaacgtgacttcagatgccgctgccttggccatcaagagtggtaatgcggtcatcttgcgtggtggcaaggaagcttttcattcggccaaagcgattgtcacagcactcaagagtggcttggaagaagctggtgtctcaccaaaggtcatcgagttagtccaagataccagccgggtctctgcgacggagttgatgaccgcaaaaggcaagattgatttattggtgccacgtggtggagcaggactcattcaagccgtagtagaaaatgcgactgtgccagttattgaaacaggaacaggtatctgccatgtctatgtggacaaggatgcggacttggacaaggccttgcggattgtggtcaatgccaaaaccagtcgtccctcagtctgcaatgcggcggaagtcttgttggtccatgaagaaattgccagccaattcctacctcgcttggaagaagctctttctggtcaggtggaattacgtgccgacagtcaggcccaggctctcctcaaccaagccagaccagcaggcgaccaagattttgacacagaatttttggactatatcatggcggtcaaggtcgtttcaagtgtagaagaggctatcagccatatcgcccaacattcgactggacatagcgaggcgattgtgacggaaaacagccagacagcagagcattttacactccatgtggactcggcagcagtctatgtcaatgcctcgacccgctttacagacggtggagagttcggtctgggctgtgagctgggtatttccacccagaagatgcacgcccgtggtccaatgggactgcgtgaaatgaccacttacaagtacatcatcacaggcgacggccacattcgttaggaggacaagatgaagattggatttattggactgggcaatatgggagcggccctagcccaagcggtcagccagcagccagatacccagctcctcctcagcaaccataacccagcaaaagcccaggctcttcaagagaaggtaggcggtcagcttttttctaatggacaaatagcagagcaggccgagattattttccttggggtcaagcctcacctgattcagacagtcttgtcaggcttgcaggaccagattagccagaatccgtcagctatctggatttccatggcagcaggagtgccccttgacagcctggcagcatttgtatcggcagataaagttatccgtatcatgcccaatacaccagtcgctatcggccaaggcatgacaacctatagcctggtcaatcaaaatctcgctccgctattggaacaaatcctagaaaaatcaggcaaggtccagcaagtgccagagagcctaatcgacgcagcaacggctatcgcaggctgcggaccagcctttgtctatcagatgattgaggctctgacagatgcaggggtgcaaaacgggctgacggcccaggatgccaaggtattggcggctcagaccctggcaggaactgctcagatggtcttaaccagcgataaacacccagcccagctgagacaggaagtgacctcgccaggcggctcgactatcgcaggtgtggtagctcttgaaaaagaaggcttccgttacgccattatcaaggcagtcgccgccgccctcaaaaagactagaaaattaggcaaaaaatagaagacagcaaaaaacgggacttttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcatgccatttctttttaaggttgctggaagtccgttcgtagtagtcttcaaggatttcttccttggacttgtaattgcggtagaaggcattgcgtgacacaccagcttttcggaccaattcagataccgaaatttgcttgagctcctttttctctaggagaaatagcagagcagtttctattgattccttagtcagttgattcgcttctttatttgattgatagaggtttttcaaagattggggtgaaattttacgacctgccatagttttccttttccgagtgtcacatctgaaagaaaatgctttcagatggggtagtttaatgatataattgtaagtaaatagagatttattgtcaaataaaaaaataaaattggaaatgagaatattatgacaaaatggaaaatcgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcggggtcggcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgtagacgaaatcaatcgcttaattagtgcaggattagattttccacaagtagtagaagcgataactcactatcgggaacacagtaagctcctctttgttttagcgaaagttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgttatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctacgaagtgaaagcgtgattcacagagtaataattttgggctgtaatttccgctatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacattttccaaacatgtgttggatgctaggagaaagaatccccttgcttagctgaaaggtcacgctccctttggaaattcgatacgggatgtttaaagcgtatttctctagacagtcttttattttattccattgagcgtgataaatgtgatgaagatgctgtgtgttccgcgcaaacataccgttatcaatgtagagcgagagagctttttgcatgataagattggtatcgtagtcgattagactcttatgtttgatgaagatatcacgtagctgattaggaaggctgattgcaccgattcggagggcaggaaagagtgtcggtgtaaaagattttatatagatgacgcgattatctgtatcaagatagtgtaaaggtaggctatgactagagtcgaaatctgctaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaattccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcttttagacaaatccgaaaatcttcatagggtaattcttgaaagtctgtaggattgagctctacagtatggtcttggaaatctctatcctctaagatataataaccgcttttttcgacagcgtagatcttattttggtattttaattccaacatagccttttggacagtgtctttgctacaatgatattgctcgcggagttgacggatagaaggtaatttctctccacgtttgaatcgatgttcctctattccagtcaaaatatcttggatgataacttgatattttttcatctaggtccccttttttatagactatgttactagctagtatatagaaaaaattgaagaaagacaatatatgaataatggggttgaggttcaggaattaagctactctatggtataattaagtgatgaaaataattatacctaatgcaaaagaagtaaatacaaatctagagaatgcctcgttttatctcctgtctgatcgaagcaagccggtgctggatgccataagtcaatttgatgtaaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccacgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggcagaggaagattgctgtcctggttggctaagaacaatattcaggaattatcggacattcaagattttaaggtggatggctttgaatattgtacttccgaatcaacggcaaaccaacttaccttcatacgatcaataaaaatgtgaaattatgaaaaagataacgttttccagcgctaaaaagggtagaaaaatattaatttctatgatataatggatgcgttataggtaaaagtctaggaaggttgtttatgaaaaagagaagcggacgaagtaagtcgtccaagttcaaattggtaaattttgcgcttttgggactttattccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcgctcttacttgttttttcactggtcatcacgtctgttgggatctatggaatgcaagaagttgtaaaattttcaacacgactaaattcaaattcgacattttcagaatatgaaatgagtatccttgtcccagcaaatagtgatattacggacgttcgtcagcttactagtatccttgctccagccgaatacgaccaagataacatcaccgctttattggatgacatatccaaaatggaatctactcaactagcaactagccccgcgacctcttacctgacagcatatcaatctatgttgaatggcgagagtcaagcgatggtgttcaacggagtttttaccaatattttagaaaatgaagatccaggcttttcttcaaaagtgaaaaaaatatatagtttcaaagtgactcagactgttgaaacagctactaagcaggtgagtggagatagctttaatatctatattagtggtattgatgcttatggaccgatttctacggtctctcgttcagatgtcaatatcattatgactgtcaatcgtgcgacacataagattttattgacaactactccacgagattcatacgttgctatcgcagatggcgggcaaaatcaatacgataaactaacacatgctggtatctacggtgtcaatgcttctgtgcacaccttagaaaatctctatgggattgacattagcaattatgtgcggttgaacttcatttccttccttcaattaatcgacttggtgggtggaattgatgtatataacgatcaagaatttacaagtttacatgggaattatcatttccctgttggacaagttcatttaaactcagaccaagcattaggcttcgttcgagagcgctactctttaacagggggtgacaatgaccgtggtaaaaaccaggaaaaagtgattgctgccttgattaaaaagatgagtacgccagagaatctaaaaaattaccaggcaatcctatctggattggaaggctcaattcaaacggatttgagcttagaaacgattatgagtttagtgaatacccaactagaatcaggaacacaatttacagtagagtcacaagcattgacaggaacaggacgctcagacttatcttcttatgcgatgcctggatcacaactttatatgatggaaattaaccaagatagtctggagcaatcaaaggcagcgattcagtccgtacttgttgaaaaataaagattttaggagaaaatatgaacaatcaagaagtaaatgcaatcgaaatcgatgttttattcttactaaaaacaatttggagaaagaaatttttaattctcttaactgcagtgttgactgcggggttggcatttgtctacagtagttttttagtgacacctcaatatgactccactacccgtatctatgtagtgagtcaaaatgttgaagccggtgcgggcttgactaaccaagagttacaagcgggtacctatttggcaaaagactatcgggaaattatcctatcacaagatgtattgacacaagtagcaacggaattgaatctgaaagagagtttgaaagaaaaaatatcagtttctattcctgttgatactcgtatcgtttctatttctgtgcgtgatgcggatccaaatgaagcggcacgtattgcaaatagccttcgcacctttgcagtgcaaaaggttgttgaggtcaccaaggtaagcgatgtgacgacacttgaagaagcagtcccagcggaagaaccaaccactccaaatacaaaacgaaatatcttgcttggtttattagctggaggtatcttggcaacaggtcttgtactggttatggaggttttggatgaccgtgtaaaacgtcctcaggacatcgaagaggtaatgggattgacattgctaggtatagtaccagattcgaagaaattaaaataggagaacaatatggcgatgttagaaattgcacgtacaaaaagagagggagtaaataaaaccgaggagtatttcaatgctatccgtaccaatattcagcttagcggagcagatattaaggttgttggtattacctctgttaaatcgaatgaaggtaagagtacaactgcggctagtctcgctattgcctatgctcgttcaggttataagaccgtcttggtggatgcagatatccgaaattcagtcatgcctggtttcttcaagccaattacaaagattacaggtttgacggattacctagcagggacaacagacttgtctcaaggattatgcgatacagatattccaaacttgaccgtaattgagtcaggaaaggtttctcccaaccctactgcccttttacaaagtaagaattttgaaaatctacttgcgactcttcgtcgctattatgattatgttatcgttgactgtccaccattaggactggtaattgatgcagctatcattgcacaaaaatgtgatgcgatggttgcagtagtagaagcaggcaatgttaagtgctcatctttgaaaaaagtaaaagagcagttggaacaaacaggcacaccgttcttaggcgttatcttgaacaaatatgatattgccactgagaagtatagtgaatacggaaattacggcaaaaaagcctaatttctcagataacataagtttgataagtaggtattaatatgattgatatccattcgcatatcatatttggtgtggatgacggtcccaaaactattgaagagagcctgagtttgataagcgaagcttatcgtcaaggtgttcgctatatcgtagcgacatctcatagacgaaaagggatgtttgaaacaccagaaaaaatcatcatgattaactttcttcaacttaaagaggcagtagcagaagtttatcctgaaatacgattgtgctatggtgctgaattgtattatagtaaagatatcttaagcaaacttgaaaaaaagaaagtaccaacacttaatggctcgtgctatattctcttggagttcagtacggatactccttggaaagagattcaagaagcagtgaacgaaatgacgctacttgggctaactcccgtacttgcccatatagagcgttatgatgctctggcatttcagtcagagagagtagaaaagctaattgacaagggatgctacactcaggtaaatagtaaccatgtgttgaagcctgctttaattggcgaacgagcaaaagaatttaaaaaacgtactcgatattttttagagcaggatttagtacattgtgttgctagcgatatgcataatttatatagtagacctccgtttatgagggaggcgtatcagcttgtaaaaaaagagtatggtgaggatagagcgaaggctttgttcaagaaaaatcctttgttgatattgaaaaatcaagtacagtaacctcatagaaatagtggaggagctatgaatattgaaataggatatcgccaaacgaaattggcattgtttgatatgatagcagttacgatttctgcaatcttaacaagtcatataccaaatgctgatttaaatcgttctggaatttttatcataatgatggttcattattttgcattttttatatctcgtatgccggttgaatttgagtatagaggtaatctgatagagtttgaaaaaacatttaactatagtataatatttgtaatttttcttatggcagtttcatttatgttagagaataatttcgcactttcaagacgtggtgccgtgtatttcacattaataaacttcgttttggtatacctatttaacgtaattattaagcagtttaaggatagctttctattttcgacaacctatcaaaaaaagacgattctaattacaacggctgaactatgggaaaatatgcaagttttatttgaatcagatatactatttcaaaaaaatcttgttgcattggtaattttaggtacagaaatagataaaattaatttaccattaccgctctattattctgttgaagaagctatagagttttcaacaagggaagtggtcgactacgtctttataaatttaccaagtgaatattttgacttaaagcaattagtttcagactttgagttgttaggtattgatgtaggcgttgatattaattcattcggttttactgtgttgaagaataaaaaaatccaaatgctaggtgaccatagcatcgtcactttttccacaaatttttataagcctagtcacatcttgatgaaacgacttttagatatacttggagcagtagtcgggttaattatttgtggtatagtttctattttgttaattccaattattcgtagagatggtggaccagccatttttgctcagaaacgagttggacagaatggacgcatatttacattctacaagtttcgttcgatgtttgttgatgccgaggtacgtaagaaagaattaatggctcaaaaccagatgcaaggtgggatgttcaaaatggacaacgatcctagaattactccaattggacacttcatacgaaaaacaagtttagatgagttaccacaattttataatgttctaattggagatatgagtctagtcggtacccgtccgcctacagttgatgaatttgaaaaatatactcctagtcaaaagagaagattgagttttaaaccagggattacaggtctttggcaagtgagcggaagaagtgatatcacagattttaatgaagtcgttaggctggacctaacatacattgataattggaccatctggtcagacattaagattttattgaagacagtgaaagttgtattgttgagagagggaagtaagtaagactcctttaaaacaaagaatagtagtaggggatatgagaacagtttatattattggttcaaaaggaataccagcaaagtatggtggtttcgagactttcgtagaaaaattaactgagtatcagaaagataaatcaattaattattttgttgcatgtacaagagaaaattcagcaaaatcagatattacaggagaagtttttgaacataatggagcaacatgttttaatattgatgtgccaaatattggttcagcaaaagccattctttatgatattatggctctcaagaaatctattgaaattgccaaagatagaaatgatacctctccaattttctacattcttgcttgtcggattggtcctttcatttatctttttaagaagcagattgaatcaattggaggtcaacttttcgtaaacccagacggtcatgaatggctacgtgaaaagtggagttatcccgtccgacagtattggaaattttctgagagtttgatgttaaaatacgctgatttactaatttgtgatagcaaaaatattgaaaaatatattcatgaagattatcgaaaatatgctcctgaaacatcttatattgcttatggaacagacttagataaatcacgcctttctccgacagatagtgtagtacgtgagtggtataaggagaaggaaatttcagaaaatgattactatttggttgttggacgatttgtgcctgaaaataactatgaagtaatgattcgagagtttatgaaatcatattcaagaaaagattttgttttgataacgaatgtagagcataattccttttatgagaaattgaaaaaagaaacagggttcgataaagataagcgtataaagtttgttggaacagtctataatcaggagctgttaaaatatattcgtgaaaatgcatttgcttattttcatggtcacgaggttggaggaacgaacccatctttacttgaagcactttcttctactaaactaaatcttcttctagatgtgggctttaatagagaagtaggggaagaaggagcgaaatactggaataaagataatcttcacagagttattgacagttgtgagcaattatcacaagaacaaattaatgatatggatagtttatcaacaaaacaagtcaaagaaagattttcttgggattttattgttgatgagtatgagaagttgtttaaaggataagttatgaaaaagattctatatctccatgctggagcagaattatatggggcagataaggttctcttggaacttataaaaggcttagataagaatgaatttgaagcgcatgttatcctacctaatgatggagtcctagtgccagcattaagagaagttggtgcgcaagttgaagttattaactatccaattctacgtaggaaatattttaatccaaaagggatttttgactacttcatatcatatcatcactattctaaacagattgctcaatatgccatagaaaataaggttgacataattcacaataatactaccgctgtcttagaaggcatttatctgaagcgaaaactcaaattacctttgttgtggcatgttcatgagattattgtcaaacctaaattcatctctgattcgatcaattttttaatggggcgttttgctgataagattgtgacagtttcacaggctgtggcaaaccatataaaacaatcacctcatatcaaagatgaccaaatcagtgtaatctacaatggggtagataataaagtgtattatcagtccgatgctcggtctgttcgagaaagatttgacattgacgaagaggctcttgtcattggtatggtcggtcgagtcaatgcgtggaaaggacaaggagattttttagaagcagttgctcctatactcgaacagaatccaaaagctatcgcctttatagcaggaagtgcttttgaaggagaagagtggcgagtagtagaattagaaaagaagatttctcaattaaaggtctcttctcaagtcagacgaattgattattatgcaaataccactgaattatataatatgtttgatatttttgtacttccaagtactaatccagaccctctaccaacggttgtactagaagcaatggcatgcggtaaacctgttgtcggttaccgacatggtggtgtttgtgagatggtgaaagaaggtgttaacggtttcttagtcactccgaactcaccgttaaatttatcaaaagtaattcttcagttatcggaaaatataaatctcagaaaaaaaattggtaataattctatagaacgtcaaaaagaacatttttcgttaaaaagctatgtaaaaaatttttcgaaagtctacacctccctcaaagtatactgattggctgaagtgaatgctttagtatagcgatttatcgtattatcattcgataaaacaaatgttcagaaacagttataagttatttctaaagggcacctctataaactcccaaaattgcgaatttggagttacgaaagccttgttaaatcaacattttaaattttagaaaattagtttttagagctcccctaaaatagaagataacagaagggagccttcaaaaacttcatttttaattggattgtagaaaaactgttaaatcaatatttagatttttaggagttcagtttttggggggagagcttaataatctatgcactatatttcgaaaaatatatggtgtaaaatcagaactgatggtcgtggcaaaaaagagaatgaggaatttatgaaaattatttcttttacaatggttaataacgaaagtgagataatagagtcatttatacggtataattataactttattgacgagatggtcattattgataatggttgtacagataacacgatgcaaattatttttaatttgattaaagagggatataaaatatccgtatatgatgagtctttagaggcatataatcagtatcgacttgataataaatatctaacgaaaataattgctgaaaaaaatccagatttgataatacctttggatgcggatgaatttttaacagccgattcaaatccacggaaacttttggaacaactggacttagaaaagatacattatgtgaattggcaatggtttgttatgactaaaaaagatgatattaatgaatcgtttataccacgtagaatgcaatattgttttgaaaaacctgtttggcatcattctgatggtaaaccagttactaaatgtataatttccgctaagtattacaaaaaaatgaatttaaagctatcgatgggacatcacactgtttttggtaacccaaatgtaaggatagaacatcataatgatttgaaatttgcacattatcgagctattagccaagagcaattaatttataaaacaatttgttacactattcgcgatattgctactatggagaacaatatcgaaacagctcaaagaacaaatcagatggcgctcattgaatctggcgtggatatgtgggaaacggcgagagaagcctcttattcaggttatgattgtaatgttatacatgcaccaattgatttaagtttttgtaaagaaaatattgtaataaaatataacgaactatccagagaaacagtagcagaacgcgtgatgaaaacgggaagagaaatggctgttcgtgcatataatgtggagcgaaaacaaaaagaaaagaaatttctaaaacctattatatttgtattagatgggttaaaaggagatgagtatattcatcccaatccatcaaatcatttgacgatcttaactgaaatgtataacgtcagaggcttacttaccgataatcaccaaattaaatttctcaaagttaattatagattaattataactccagattttgctaagtttttaccgcatgaatttattgttgtaccagataccttggatatagagcaagttaaaagccagtatgttggtacaggtgtagacttgtcaaagattatttctttaaaagagtatcgaaaagagataggctttattggtaatttgtatgcgcttttaggatttgttccgaatatgctcaatagaatttatctatatattcagagaaacggtattgcaaacactattataaaaatcaagtcgagattgtgagagttgtttacttttatttgtaattttaaaagtaatgcaggcagataggagaaaaacgtttggaaaaatgagaataagaattaataatttgttttttgttgccatagcgtttatgggcataattattagtaattcgcaagttgttctagcgataggcaaagcttctgtgattcagtatctatcttatttagttttgattttatgtatagttaatgatttattaaaaaataacaaacatattgtagtttataaattagggtatttgtttcttattatatttttatttactatcggaatatgtcagcaaattcttcctataacaactaaaatatatttatcaatttcaatgatgattatttcagttttagcaacgttgccaataagtttgataaaagatattgatgattttagacggatttcaaatcatttgttattcgctctttttataacttcgatattaggaataatgatgggggcaacgatgttcacgggggcagtagaaggtatcggttttagtcagggttttaatggaggattgacgcataagaacttttttggaataactattttaatggggttcgtattaacttacttggcgtataagtatggttcctataaaagaacggatcgttttattttaggattagaattgtttttgattcttatttcaaacacacgctcagtttatttaatactattgctttttctatttcttgttaatcttgacaaaatcaaaatagaacaaagacaatggagtacgcttaaatatatttccatgctattttgtgctatttttttatactatttctttggttttttaataacacatagtgattcttacgctcatcgcgttaatggtcttattaatttttttgagtattatagaaatgattggttccatctaatgtttggtgcagcggatttggcatatggggatttaactttagactatgctataagggttagacgcgttttaggttggaatggaacgcttgaaatgcccttactgagtattatgttaaaaaatggttttatcggtctggtagggtatgggattgttttatataaactttatcgtaatgtaagaatattaaaaacagataatataaaaacaataggaaagtctgtatttatcattgtagtcctatctgcaacagtagaaaattatattgtaaatttaagttttgtatttatgccaatatgtttttgtttattaaattctatatctactatggaatcaactattaacaaacaactgcaaacataaattggcaggaatagagttttgagttgctattaatttggtagagcatatgttctataggtggcaagatagaagatagtattttttacatgatgatttttatgatagcaaagcaagttacggcataaaaggaattagaggatggaaaaagtcagcattattgtacctatttttaatacggaaaagtacttaagagagtgtttagatagcattatttcccaatcgtatactaatctagagattcttttgatagatgacggttcttcagattcatcaacggatatatgtttggaatacgcagagcaagatggtagaataaaacttttccggttaccaaatggtggtgtttcaaacgcaaggaattacggtatcaaaaatagcacagcaaattatattatgtttgtagattctgatgatattgttgacggcaacattgttgagtccttatacacctgtttaaaagagaatgatagtgatttgtcgggagggttacttgctacttttgatggaaattatcaagaatctgagctgcaaaagtgtcaaattgatttggaagagataaaagaggtgcgagacttaggaaatgaaaattttccaaatcattatatgagcggtatctttaatagcccttgttgcaaactttataagaatatatatataaacaaaggttttgacactgaacagtggttaggagaggacttattatttaatctaaattatttaaagaatataaaaaaagtcagctatgtaaacagaaatctttattttgctagaagaggtatacaaagtactacaaatacgtttaaaaaagatgtttttattcaattagaaaatttagaagaaaaaacttttgatttgtttgttaaaatatttggtggacaatatgaattttctgtttttaaagagacgctacagtggcatattatttattatagcttattaatgttcaaaaatggagatgaatcgcttccaaagaaattgcatatatttaagtatttatacaataggcattctttagatactctaagtattaaacgaacgtcctctgtttttaaaagaatatgtaaattaattgttgctaataatttgtttaaaatttttttaaatactttaattagggaagaaaaaaataatgattaacatttctatcatcgtcccaatttacaatgttgaacaatatctatccaagtgtataaatagcattgtaaatcagacctacaaacatatagagattcttctggtgaatgacggtagtacggataattcggaagaaatttgtttagcatatgcgaagaaagatagtcgcattcgttattttaaaaaagagaacggcgggctatcagatgcccgtaattatggcataagtcgcgccaagggtgactacttagcttttatagactcagatgattttattcattcggagttcatccaacgtttacacgaagcaattgagagagagaatgcccttgtggcagttgctggttatgatagggtagatgcttcggggcatttcttaacagcagagccgcttcctacaaatcaggctgttctgagcggcaggaatgtttgtaaaaagctgctagaggcggatggtcatcgctttgtggtggcctggaataaactctataaaaaagaactatttgaagattttcgatttgaaaagggtaagattcatgaagatgaatacttcacttatcgcttgctctatgagttagaaaaagttgcaatagttaaggagtgcttgtactattatgttgaccgagaaaatagtatcataacttctagtatgactgaccatcgcttccattgcctactggaatttcaaaatgaacgaatggacttctatgaaagtagaggagataaagagctcttactagagtgttatcgttcatttttagcctttgctgttttgtttttaggcaaatataatcattggttgagcaaacagcaaaagaagcttctccaaacgctatttagaattgtatataaacaattgaagcaaaataagcgacttgctttactaatgaatgcttattatttggtagggtgtcttcatcttaattttagtgtctttctgaaaacggggaaagataaaattcaagaaagattgagaagaagtgaaagtagtactcggtaagaatgttgtaataaatggttgaaagaaaaggggattaaaatgaatccaacaaatagtagaatagcactctttgatacgattaaatgtatcatggtactttgtgttatttttacacatctggattggtctgttgagcagcgtcaatggtttatctttccgtatttcgttgacatggctgttccaatttttctgttgctttctgcctattttcgaacgaataagtggaatacaaaacaagagacgctaaagctcaagttcagcagtggtataaaagaaagtataaacatgctttgtctctatgctatcgtgatggctgttaatgttttattgagctattcgagaaccatctgataggagtaaagcctttttcaggttcttcatcgctccgttcatttgtcctgtggctactttctggagaatcgggtccagggagttgggagttactatgttccgttgttgattcaggtagtttttttattaccaattttgtatgttcttttcgagaaaaataaatggttgggcttgcttacttgttttttagtaaacttttcagtggatgccatatttgctaacatggctgaacacggcatatatatatagactaatatcacttcgttatctttttgttctagggcttggttttttctttcaaagcaggatgtgcgttccaaggtagatactttcattgcgaccctatttgggattattggagcaattctgatttttgtgaatcattctatagagcccttctcctggttttatggttggaagtctacttcctttctatgcgtcccatttgcgtatgctatgctattttttatgataaagtatggacagaagattccagcaatactgttgtcaaaattgggagttgcttcttatcatatctacttgacccagatgctgtatttttcagtagtcgcaccatttttagcagtgcaatttaaggtatcttcgttgaatttgtggaacggcttgtttacctttctaatttgcctgtttggtggctatattttctacaaagtggatctgtttatgagagtacgtggaaaacgataatgactcatttcagattagcagatgccatttcgtttattagcagattcgcatgttaatattccgacaaagaaattcaaataggttgacgagagaggagtggtatctgtttctaaaccccagtatccccctttattttcaaagctatatttattaactgaacaaggagaatttttaagagaactgtttgtttaatcccagcacgatctggttcgaaaggcttaccgaataaaaacatgctatttttggacgggaaacccatgatttttcacacgattgatgtggcaattgaatcaggttgttttgagaaagaagacatctatgtcagtacggattcagaaatgtataaggggggcacctctataaattcccaaaattgcgaatttggagttacgaaagccttgttaaatcaacatcttaaattttagaaaattagtttttagaggtccccaaggggatttgcgagacaagaggcatcaatgtattgttaagacccaaagaactatctacttatcatactccatcgaatgaagtcagtacgcacttttttacgaatctggattttatgaagattgtatatttgttcttctgcaagtcacctcaccgttacggactggcgaacagataaaagaagccatgaatatgtacttacagggggactcagaaaatgttttgcatttcaatgatgaagggcaagaaagagtgaatcagtacattatcgaagctgtacaggggttataaaaaggggttacttatccttaaagtctgtatgtagaaggagaaaaattgagacgaatttatatttgccatacgatgtatcagatcctgatttccttgttaaagatggacgttgagagagatagtttgatgtccgttgatatcatcgggcattttccagatgtcagggagcaactgcagcagcatgttcatctaatcgaggagacggagcgttcatttgatctatattctttgatagctagatcaaaaacaaaagaacgcctttccttgttacagagctatgacgaggtgatcatttttcaagatcaccgtcaagtcggtcattttttaaataaacatcggattccctattctcttttggaggatggttataattttttcaaggataaaagagtgtgcgatttggagtcaattcaatcatctgtctggaaaagactcttttatcaatggtattttaaaccaacatatttgattggttcaagtctctattgtcaatccattgaggtcaatgatctgtcgctcgtacaatttgacgaggcttataaaccctttgtagaagttccgagaaagcaattatttgatcaagcatcgccagagaaggtgcaagcgctgctgcagatatttggagcaagggcgatagtagcggatgaagagtcttctcaaaaacgattgctattattgacccagcccttgtcttgggattatcatgtgaccgaagaggagttgttggagatttatgtagcaggtcttgccccttatcgggaagactatacaatctacataaaaccgcacccacgagatggggttgattattcatttctgggtaaggctgtggtgcttctgcctcaaggtattccgtttgagttgttcgaaatggcaggtagtatccgttttgatatcggtatgacctatagttcgtctgctttagattttttaaattgttttgaagagaaagtgtatttaaaggacacttttcctcttctttcaaaaaatgatattttgcgtgaggggatagaataggaggattcatgtctaaaaaatcaatagttgtctcaggtctcgtctatacgattggaaccatcctcgttcagggattagccttcattaccctccccatctatactcgtgtcatttctcaggaagtatatgggcagtttagcttgtataattcgtgggtggggctagttggtctctttatcggtctacagttaggtggggcttttggcccgggatgggtacacttccgcgagaaatttgatgatttcgtatccaccttgatggtctcttctatcgctttctttttaccaatttttgggctatcttttctcctcagtcagcccctatcgctcctatttggtttgcctgattgggtcgttccgcttatctttttgcaaagttttatgagtgttgtgcaaggattttttacgacctatttagtgcagcggcagcagtccatgtggactttactcctatcggtactgagcgctgttatcaacactgctttatctttatttctcatcttttcgatggagaatgatttcatcgctcgtgtaatggcaaactcggcaacgactggtgtttttgcttgtgtgtccttgttgtttttctataagaagattgggcttcattttcgaaaggactatcttcggtatggtttaagtatatcgattcctcttatttttcatggattaggtcataatgtactcaatcaatttgacagaatcatgctcggcaagatgctaacactgtcagatgtagccctatacagtttcggctacacacttgcgtctatcttacaaattgtgttttcgagcttgaatacggtatggtgtccgtggtattttgagaaaaagagaggtgcagataaagatttgctcagttatgtccgttactatctggcgattggcctgtttgtgacttttggatttctaacaatttaccctgaattagcgatgttgttaggtggatctgagtatcgtttcagtatgggatttattcccatgattattgtcggggtgttctttgtatttctttatagttttccagccaatatccagttttatagtggaaatacaaagtttttgccaattggtacttttatagcaggtgtactaaatatttcagtcaactttgttttgataccgacgataggaatttatggtgctgctttggcaacgactgcttcctatctgttgttgctagtcttgcattattttgttgctaagaaaaagtatgcttacgatgaagttgcgatttcaacatttgttaaggtaattgctcttgttgtcgtctatacaggcttgatgacagtatttgtcggttcaatctggattcgttggtcactaggaatagcggttctagtcgtttatgcctacatttttagaaaggaattaacagttgccctcaatacattcagggaaaaacggtctaaataagggcacctctataaactcccaaaattgcgaatttggagttacgaaagccttgttaaatcaaacattttaaattttagaaaattagtttttagaggtccccatataaaaacgtcccaaatgagaggtgctcataagaattgaccatcactgccatctacccaaagttcaagtattctctaccatgaaaattgtgctataatcaagtataaagaagggaatgtttcttaaaggacgtatgcgcctctgcttatgccagaagtcatgaggtaaatctccctaaaaattgggtagaaaagcagattaaacttccaccaatctattgaagatcgtgtgaagaagcaggctttagaagcaacaagccctgagactattcgaaagaaatctagggctattttttctaatcggctatcagaagtgaagtagcgatctttattagtgttcttttactacttaaggaaaaccaagctgctccctcaagactttatgggagcgatttacagtcatttttagaaaggaaataaaatggtttatattattgcagaaattggttgtaatcacaacggtgatgttcatctagcacggaaaatggtagaagttgccgttgattgtggtgtggatgccgttaaatttcagacatttaaggcagatttgttgatttcaaaatacgcaccaaaggcagaataccaaaaaattacaacaggagagtcagattctcagctcgaaatgactcgtcgtttggaattgagctttgaagagtatcttgatttgcgtgattactgtcttgaaaagggagttgatgtgttttcgacaccttttgatgaggaatcattggacttcttgattagcacagatatgcccgtttataagattccatctggtgagattaccaatcttccctatttggaaaaaattggtcgtcaagctaagaaagttattctttcaactggtatggctgttatggatgaaattcatcaagcggtgaagattttgcaggaaaatggaacgaccgatatttcgattttgcattgtacaaccgagtatccaaccccttaccctgctttgaatttgaatgtcttgcataccttgaaaaaagaatttccaaacttaacaattggctattcagaccatagtgttggttcagaagtacccatcgctgctgcagcaatgggagctgaattgattgaaaagcactttactctggacaatgaaatggaaggaccagatcataaagcgagtgctactcctgatatcttagcagccttggtaaaaggagtgaggatagtggaacaatctcttggtaaatttgaaaaagagccagaagaagttgaagtacgaaataaaattgtagctagaaaatctattgttgccaaaaaagcaattgctaaaggcgaagtctttacagaagaaaacatcactgtcaaaagaccaggaaatggaatttcgccaatggaatggtacaaagtcttggggcaggtgagtgagcaggattttgaggaagaccaaaatatttgccatagtgcttttgaaaatcaaatgtaagcggagtaaggatgaaaaaaatttgttttgtgacaggctctcgtgccgaatatgggattatgcgtcgcttattgagctatctacaggatgatccagaaatggagctggatcttgtagtgacagccatgcatctagaagaaaaatatgggatgacggtcaaagacatcgaagcggacaagcgtaggattgtcaagcggattccattgcatttgacggatacgtctaagcagacaatcgtcaaatctttagcgaccttgacagagcaactcacggttctttttgaagaagtccagtatgacttggtgttgattctgggggatcgctatgagatgctaccagttgccaatgctgcgttgctttataatattcctatttgccatattcatggtggtgaaaaaaccatgggaaattttgatgagtcgattcgccatgccattaccaagatgagtcaccttcatctgacatcaacggatgaatttagaaatcgtgtcattcaactaggagaaaatcccaaccatgtactgaacatcggagctatgggtgttgaaaatgttttaaaacaagactttttgacaagagaagagttggcgatggaacttggaattgattttgccgaggattactatgttgtactctttcaccctgttaccttggaggataacacagccgaagaacaaacgcaggccttattagatgctctaaaagaagatggtagccagtgtttgataattggatccaattcggatacacatgccgataagataatggaattgatgcatgaatttgtaaaacaagactctgattcttacatctttacttcgcttccaactcgttattaccattccttggtcaagcattcacaaggtttaatagggaattcttcgtcaggtttgattgaagtgccctcattacaggttccgaccttaaatattggaaatcgccaatttggacgtttgtcaggaccgagtgtggtacatgttggaacttctaaggaagcgattgttggtggtttggggcaattacgtgatgtgatagattttaccaatccatttgaacaacctgattctgctttacaaggttatcgagctatcaaggaatttttatctgtacaggcctcaaccatgaaagagttttatgatagataggggagaaagtttgatgaaaaaagtagcctttctaggagcgggtaccttttcagatggtgtccttccttggttggatagaagtcgatatgaactcattggatattttgaagataaaccgatcagtgactatcgtggctatcctgtatttggtcccttgcaagatgtcctaacctatttggatgatggaaaagtagatgctgtcttcgtcactataggtgacaatgtcaagcgcaaggaaatctttgacttgcttgccaaagatcattatgatgctttgttcaacatcattagcgagcaagccaatattttttccccagatagtatcaagggacgaggggttttcataggtttttcaagttttgtaggagccgattcctatgtctatgacaattgtatcatcaatacgggtgccattgtggaacatcataccacggtggaggcccattgtaacattactccaggagtgaccataaatggcttgtgccgtatcggagaaggcacttatattggaagtggttcaacagtgattcaatgtatcgagattgcaccttatacaacattgggggcagggacagttgttttgaaatcgttgacggagtcagggacctatgttggtgtacctgctagaaagattaaataggtgaattgatggaaccaatttgtctgattcctgctcggtcaggatcaaaaggtttaccaaataaaaacatgttatttttagatggtgtaccgatgattttccataccattcgagctgcgattgagtctggatgttttaagaaagaaaatatatatgtcagtactgattcagaggtttacaaggaaatttgtgaaacaactggggttcaagtcctcatgcgtccagctgacttggcgacagattttacaacctcttttcaactgaacgaacattttttacaagatttttctgatgaccaagtatttgttctcctgcaagttacgtccccattaagatcgggaaaacatgtcaaggaggcgatggagttatatgggaaaggtcaagctgaccacgttgttagctttaccaaagtcgataagtctccaacattgttttcaactttagacgaaaacggattcgctaaggatattgcaggattaggtggcagttatcgtcgtcaagatgagaaaacactctactatcctaatggagcgatttatatttcttctaagcaggcttatttagcggataaaacttatttttctgaaaaaacagcggcctatgtgatgacgaaggaagattcgattgatgtagatgatcactttgattttactggtgttattggtcgaatttactttgattaccagcgtcgtgagcaacaaaacaaaccattttataaaagagagttaaagcgtttatgtgagcaacgagtccatgatagtcttgtgattggcgatagtcgtctgttagccttgttactggatggtttcgataatatcagcatcggtgggatgacagcttcgacagcacttgaaaaccaaggtctctttttggctactccgataaagaaagttttgctttctcttggtgtgaatgatttgattactgactatcccttgcatatgattgaggatactattcgccagctgatggaaagtcttgtttccaaagcagagcaggtttttgtgacgacgattgcctacacgctgtttcgtgatagcgtttcaaatgaagaaattgtgcagctgaatgacgttattgttcagtcagcaagtgaactgggtatttcagtgattgatctaaatgaagttgttgaaaaagaggcgatgcttgactatcagtataccaatgatggattgcatttcaatcagattggacaagagcgtgtgaatcagctgattttgacaagtttgacaagataatttggtgatagaagctatttcagtggctagactatgttggtatgtgttttagagccaaggaataacatctgtagaggatgctagccttgagaattgacaaccatttagttgtttaattatataaggggacctctaaaaactccctaaatttcccaaaaatgagataatagaataaaaagtaatgaggagagctgtcatgcatttattcacagacgatgaaaaaatcttgtcaaaactatcagagaaaggcaatcccttagaacgtttggatgccgttatggattggaatatctttcttccattgttgtcagagttattcagtcgtaaagataaagtcatcagtcgtggcggtcgtcctcacctagactatctcatgatgttcaaagcgctcttgcttcaacgtcttcataacctatctgacgatgccatggaatatcaactgctggatcgtatatcttttcgtcgttttgttggttgtcatgaagacactgttcccgatgcgaaaactatctggctctatcgtgagaaattaaccaagtcaggtcgtgaaaaggagttgttcgatttgttctatgcccatctcacagatgaaggggtgattgcccattcaggtcagattgtggatgctacctttgtcgaatgccctaaacaacgcaattcacgtgaggacaatcagaaaatcaaaacttatcgaaaattatgaggtcacaacagctagtgtacacgactccaatgtcctagctcctctttgtgatgccaatgaagcggtttttgatgacagtgcttatgttggaaaatcagtaccagaaggttgtcgccaccacacgattcgtcgtgcttttagaaataaaccgttgactgagactgataaggtcattaatcgacatattaccaaagtccgttgtcgcgttgagcatggttttggcttcattgaaactaacatgaaaggtaacatctgtcgagcaattgggaaggcacgagctgaaaccaatgtgaccttaaccaacctgctctacaatatctgtcgttttgagcaaatcaaacgactgggattaccatcgtgggcttagtgcgcccaaaaataggaaaataagcaaaaagaggctgggcaaaaactagtttctcacaataaaaaaacggctctttgtcaactgtagtgggtagacgaaaagctaacacctagagaggacgaaattcgttctctcatttttgatgtttaaagcgtaaccgcctaataacaaggtatctatccaatcacacattcctccattatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactatactgttataaaaaacaaactggaggattcattatgtcacagcccgtcgtcccattgactattccccaatctcgccgctttgaaaagaaaagcagaaacgatattctgatgaaaattcgtctcggaaaaacggaagtcacattcttccaatctatcaaccctgaagtaatggaaacaatcttggataaggtactgcattatgaccatccgactcagtgatttaggtcaagtcttcttggtctgtgggaaaacggatatgcgtcaggggattgactctctcgcctatcttgtcaaaagtcaatttaatctggatcccttttcaggtcaggtctatctcttctgcggaggtcgaaaagaccgattcaaagctctttactgggatgaacagggattttggttattgtataaacgttttgaaaatgggaaattggcctggtcaaacaatgaagaagaagtcaaggctctaacttccgaacaagtagattagctcatgaaaggattttctatcattccaaaaataaatgtttcaaaaagtcgtgatttctattgaaatcatggcttttctttgtgtataatgagataaaaagaaggaggagcgagcgtatggatgagttgttggcaattattaaacaacagacctcaacgattgaacaacttaccaatgagctaaccctccttcgagaacaggttgactatctgagacagaaactctacggaaaatcatcagagaaagttgtgtatcaacccggtcagctgagcttgtttggggaggaaagcctccctgaagaagaagctgacttacccagttgaaacagagatcatcacttataaacgcaagaaaactaagggagttcgtcaggctatttttagtcagttcactccagagatagtgcatcacgaattgcagggcgaagactgcacttgtccagactgtcatggtcagttgaaagagattggctcagctgttcaacgacaagagttggtcttcattcctgcacaattaaagcggattgaccatgttcaacacgcatacaagtatcaggcatgtagccagaagaatctgagcgataagattatcaaggctcccgttcctaaggcacctttggcacacagcttgggttcagcctctatcatcgctcacaccattcatcagaagttcaatttgaaggtgccaaattaccgtcaggaagaggattggcataagcttggcctgcccatcagtcggaaggaaatagccaactggcatatcaagtctagtcagtattatttcgagccgatttacaacctgttgcacgagaaattgttggagcagcctattctccatgcggatgagaccgcctacaaggtcttagaaaatgatggtcagttgaccttcttgtctgggaaacatgaggaaaatggaattaccctctatcatcatgacaaacgacggagtggcttggttgtggaggaggttcttggggactatgcgggctacgtacattgtgacatgtggagtgcttatcgtcaattagacaaggctcagctggttggttgttgggctcccgtcaaacgaaagttctttgaggcgactcctaagaagacagacaagacttctttaggagcccaagggcttagcctattgcgaccgcctgtttgccttggagagttgactgggctgacttgtctagcgaggagcgactgcataaacgctggctcccttgatggacgagttctttgactggtgtcgtgagcaatctgttttgccaggctccaaattgggtactgctttggagtatagcctcaaatacgaaaccaccttccgaaccgttctctcggatggtgacttggtcctgtctaacaacatggctgaaagggctatgaagaccttggtgatgggcagaaaaaattggttgttctcccaaagttttgagggagccaagtcgacagctatcattttgagtcttttggaaacggccaagaggcacgaacttgatacagagaaatatatgacctatcttctagacaatctacctaacgaggaaacactcgctaaaaaagaagttctagaggcttatttgccatgggagaagaaaattaagagagcatgtaaatagaaaaaggttccagagtcaacaggactttggagccttttcaatataccttattattgggcggttacaaagtagcctaggaaacgaagccgaagatagaactggagttggagttcatcaaggcaagttgacaacggataattttgattttcgaagagtatcaataaaaatcaaagatagcaagtctaagctacttatgaaagttctataatgaagtcaaacgtgggacaactttacaacaagtgcgaaaagggctgtacaaaaaagtctattctgctgactatgcacaaacggtataccgaactaatcgaaaacgatcggtaaaaaagataatcctaacgaaagaattgaaagagaaaattttacactatactaagcaaaaattttctcctgaaatgatggttaagaagaagaaaatgaaagtgggtatttcaaccatttactattggtttcatcatggccatttaggattgacgaaagcagatatgctttaccctagaaaagggaaaagggtcaagaagcaagctagtcctaactttaaaccagcaggaaaatctatcgaagaacgtcctgacgttattaatcttcgcttggaaaacggtcattatgaaattgatacagttctactaaccagagggaaaaatcattgcctcttagtcttaaccgaccgacgaagcaggcaccaaatcatacgattaattccaaacaaaaccgccgaatcggtcaatcaggcactggagggaatcttgagggaacatcgtatcctgtctataactgtagataatggtacagaatttagtcgtctggctgaagtgtttcctgaggagtatatctactatgcgcatccctattcttcatgggagaggggaacgaatgaaaatcacaatcgattgattcggagatggttacctaaaggaaccaagaaaacgactccaaaagaagtcgcttttatcgaacattggatcaacaactaccctaaaaaatgcttggactacaagtcgccgagtgaatttcttatgggtggctaatttcaacttgaaatttggggtctaagctacttataacatttgaaaccttaatttataagtttgagttgaggattgtggatttcaagcagctgttttcttctaaaaaaataacaaaatcgaaacggtccatatccactttgagtggtagttggctatttttgattttaaatgagtatcacaccccatcgtcccattgactgttccccaatctcgccgctttgagaagaaaggcagaaatgatattctgatgaaaattcgtctcggaaaagtggaagtcacattctttcactctatcaaccaagaaacattagaaacaatcttagataaggtactattttatgaccatccgactcagtgatttaggtcaagtctacttggtttgcgggaagtagtggtgtgatttggttaagaggattatgctcacttagaatttctacctgcttgctttgagagacatgagtgtagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagacttaagcgcacactttgttctttaagatgatcatcgttttcacactggtaaatagataactagaatgactacaatgatgcgctatatagtcttcaagtaacgaaagtgttttatcgtttccaatatagagtagtcgcactttctttccttttccgagtatttgaatggttctattttccaaattgatattatcaagttttaaattacataattcagagatgcgtagaccagttgataaaagtagcgagataaggagtagatttcgcatagctttccgattagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttacgttttaatgtgctagtcttttttatatgttggttgagaaaagtaagataggacctaatatcattggtcctaaagctataatactaatgtaaattggatttgtatgcttggatagtatgagaactaagtcgtctttgaatagcacaaaagtcaagatatctctggatagtgtcgtaattcataatataatctccttaatatgtcgtaataaagctattatatacgataatttatcaatttactaatgataataaattgttatcggtaggagatcttatgaagcaattgctacagtattatttacaaaattttgataaagagtgctctaagaccaatttatttttagttgctaatttacaaaaacaaactaaaaaaatgtcttattatacaattgaacatgcatctggtcgtgaatttttttcgctatcagaatttgaggaaatagcttcagcactgttaaaaactggtttatgtttgaacattttttatactgaaatagatttcgtggagtatatattaaaatactattagcgcttatcaaaagaaactttgttagtttataatttggctagagacggtcgaaaagaaggaaaaaaatcgctgattccctctttttgcgattactttagcattaattatacaggttcaaatgcactaacagtttcattatgtcgtaataaatttatttggggagctattgcagattactttaatattccaacacccaaaactgtttgtataaaagatggcgaggtattaggtgagccttttgaagctcaaaaatatattagaaaagaaatttcggaatctgcaagtattaatctttccaatgattcaataatgaataattttgagtggaaaaatatagaaaaaaagattttctgttgcaagagtgtatttcaggaattgaagttgaagtcccttttttaatattaaagggaaatatcttgtattagatccagtcaaaattgtctcttcttcagaaattataacaagcaaactatctgataataatagttattcatttgaatggttggaagatcaacaaatatgtacaaaattaaaagagtcaacaaaaaaactcgccaagtacttaggtataaccacttacggacgagttgattttagaataaagtcagatgggagttattttgtttttgatattgcaacaatgccttacacaactgaccatcgttcatttaattttaactttgagcaatatggacttacaatgactgatcttcataaactagtaatattaagtagtttataatgcactagtatactgtatatcagttagcataaggcctcttcgaaagtaattccattctcttgaagcaaacttggattgtgatagaaattcagaaaattcctttcctgtttttatatttgattcgaaaatctttttatagcgacgatgtttttcaattaataattttttatttgaattgaaaataataggtgagaaatcttttaattgattgtatttattttttgcttgtcgatgcttactctctagtaacaacaagcaaaattcaaaccatccaaaataataacgataaaaatcatctattgaggtatcttcaaggtcggctaagtcctcaacatccatcaattcttcaagtatcgttttatagcttctgtacccttttgttttagaataatatagagaaattgcacataaatttgtatacattaagtgtttactcacatcatttaactcatattcagtaagaatgctttcaaaccgagatttccaataatcaaaatctccttccatacctgaaagaaagtccagtacaacaaaattatttttagatttccagtatagtgggagattgtgtttatctgatagtgtttctatttcttgtttcacctgatttgctcgctcatagttggaagaaacaagtaataatcctagaagactaccaagtgtataatactgttcaatttcatcatcgacatcgttaaaaaattttaaagctttattggcatcattgattgatctatcattatccttgtataaaaaactttttcttaaatatatattttcaagatattgtgcattttgctcaatatcttttgttgtataaaattttttgacaatattttcatttaaaacttggaatttatcaatttcattaagtttatctatattaagtttatctattaaatgaggtaatagcatgtaaatacatgaaagatagtgaataggctcaacaataacatctttggcgctttcagctaatatattttcgtaaagtgtatcacaaagtgaatgaaaagaaaaatcttgtgatgtatttccttgaaagttaatatcattctttaataatatcgaagataataatgaattttcgggtaaaatttcattataaagagagttagtaccatttgtatatttgtatttgatacatttaaaaaatattgatttagtctcttcagtgagaaattcaagtttatataaactctttttttcgctttctagtatctcgttttgatttaataaatattcataccagagtaagtatagtgataataaatattcttgactctctttaagtcttgataagatttctatctttaatctgtaattaaatggctcctttccgcatagataatgatagtaccgtctatagatttctttttgtcctttttcaaccgttaaaagaagcttatctttcataatcaatatcagactataaaaatttgttctattttttacaggaatcaagactagtaatttttttaagatatcaatagctttttcaatttgaaaagtttttaaattaaagtattcttcggcatcatacgggttgaaatattcaggaaggactgatagctgataaatgaaatcaatttcaattttattctttctaaagtctatttcaatcgtatttaacaaatcatctaataacttttcaatcttagaattattctgtgatagtaaaataaaattataaattttttccaagtttccctttgttagaggatacagtgtatcctctaagttatcagagatgtttgaagtttgtataatattacctaaagtatcttttaaatcgtttaattcaaaatgatgaacatcaaagttttttgaaaatctaatatcattattttttaactccgagcctccaattacaataataatcgatttattatattgcttttcataatgggagatattattgagaaggcgtataaaaaataattttagttcactccctagccactcccaatgttggattagaaatattaatctgtaattgttgctattatttagtattttcttctctatctcagttgaatcatattttaatgacagaccagctgttccaaatccttgtatcgagttattaacagatactgaaataggcttgaaaaatttttctgcaaatgaaagtttatactcgtctgtaatattgttatctccgaaatcactatacaatactgtaccattcccgtcaatttcgctttccaatagttcctgtgatattgtatcaaatgctaaggattttgataaagaatcttcgaacgggatatatagtgaaagtgacttttgatctgtatgtgcttgaataattgaataagtaatttctgttaaaaattgattccaatgagacataattaaactttcctaccgataacaatttattatcattagcataccataatctacatttgttttatagattttattaaaatttttatagtaaatatttttagttttttgtttcaaaaatgtaatggagattgatttttcacaagtaattgtcataaaaatcagaaaatattttataaatatgataaaatgaaagtgatactagtttgaggtaaggatatgaaattaagaagaagcgtagaaaaactaaagggaacgattcgtgtcccaggtgataaatcaatcagtcatcgttctattatttttggttcccttgcaaaaggtgttacccgtttccacaatattttacgtggggaagatgtcttgtcaaccatgcaggtctttcgtgatttgggtgtaaaaattgaagacaatggtgatattgttgaagtacacggtgttggctttgatggtcttcaagcccccaaaaatgatttggatatgggaaattctggaacctcgattcgtttgatttcaggcgttttagcaggtcaagactttgaggcgactatgtttggtgatgattccttatccaaacgtcctatggaccgagtaactattccactcagtcaaatgggagtagagatttctggacaaactgaacgtgacctacctccgttgaccatcaaagggaataagaatttaaaaccaattcgctaccaactccctgtagcctctgctcaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgctttttggttggttgctggcttaatcataccaggttcaaaaattgtccttgaaaatgtgggaatcaatgaaactcggactggtattttagatgtcattaaagctatgggtggtaaaatgactctttctaacatagatgaacttgcaaaatctgctaccattacagttgaaacgtcggaattgaaggctacggagattgcaggcgaattgattcctcggttgattgatgagttgccgattattaccttactagcgactcaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaaggattgctggacttacctagtaattgtatcgtatcaactggtggtggtgtgattaaatctgaagtaaacagggaattgctgttggcaaatagggaggacaatgtacttcttactgcctcctttgaagtttcctatcagagaattcgtaaggatagacagtcgcaaagacctctctttttacagtgtagtaaggaagagtttgaagccctctatcgtgaacgaatggcactttatcaaggtttagccgatactgtaatcgatacagataaactgattccagaacaagtagcaaggaaaattttatgcaagtagcctatctaggacctcgtggttcttttacacatcaagtggcccagcaggtctttccgactgcggatttgcaggcttttgagacgattacagaggttatcaaggcctacgaaacgggggaagttacctattccgttattccagtagaaaactcgattgaaggtagtgttcatgaaacgattgactacctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagttagtacagcctatgctgctcgctttgtggcagaacaccctgaacaaccatttgcggcaattgctccgcaagcggcagcagttgaatatggactggaagtaattgcgcaagacatccaggaaatcagcgagaattttacacgcttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccgacccctgaaaacggctttgggtgagtattttttcatactggatcttgacaatcagtctgaggaattattaacctattctcaaaaagaattgactagtttagatataacctataaagtactagggaattacctggtctatatgaccagctaggatgaagacagatgaataaaaacaataatatcctaacccatcatgaacaattgaggttagattatttgcaaaaaaatatccactacttaaatgacaaagaaagtcgcgagttggattatctattatataaaaaagagctgagagaacggcatggaagtccaaggcaatctctacgtagcttcacaccaacggcttatgaagatgactacttcgaggaagattattttgaagaggatgatgagcaagaggaactgttgcctcgctatcctgaacgtaaatccagaaaaacaagacaagccaaacctcaacggtttcagtctcctcgtatcggtcccaaagcgaaagtacctaaacctaaaaaagctcgtaaaaagggtggtttcaagcgctttattggtttcgtattgcttgctatagcgctagtgattgtagcgatgggctatagttttttcaaaggtatgaatagcgtgagtgagaagccagtagctgaggtcttcaacggcgtagatacatcgaatgggacaaatattttaattttgggaacagacggtcgtgttggcgaaagctcaggtgaaactcgaacggataccatcatggttctaaatgtgaataacacggataacaaagtcaaacttgttagctttatgcgggataccttggtggatattgagggatatgaatataaactcaatactgcctatactttgggagaacaggataatcagcaaggggctgaagaagttcggaaggcgttgaagaatagttttgacattgatatcaagtactatgcgatggtggattttgcaacctttgcgacaacgattgatacacttttccctgagggcgtaacgattgatgcacagttttcaactattaatggtgaagtcgttagctcagtagaagtgccgaatgatttacagctggaagaaaatgctcctgcttatcaaacgattcaggtcggtgtacagcagatggatggtaagaccttgcttaactacgcgcgctatcgttcggatgatgaaggtgattttggtcgtacgagacgtcaacaggaagtgctatctgctgttatgacacaggctaaaaatccaatgaaactattctctggctccgaagctataggtaaggttgtggccatgactccgacaacagtaccgcaaagctttatgtggctacagggaccaggccttctattggatgcggcaaatggtatcgaacgtgttacaatcccagaaaatggagactggattgacgactatgatatgtatggtggtatggctcttcgtgttgattttgaaaaataccagcagcgcttggctgagttaggcctgcgttaagaaatatggtatactagaagtgacttcggtcactttttagtggtccaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcacaagaccgtaatcaggacttggattttacctatctaagaacaggtattgctgacttggggcatctcacttatccagcccaactagcttttaagaaaaaacaagttgagaatagtctacgtaagattgcaggcatttcagaaatagcagtagcagatacgttgggaatggacagtcctcttgcttatcgtaataaggcagctgttccagttcgtcgtgtgaatgggcagttagaaacaggattcttccgaaaaaattcacatgatttagttccgattgaggatttttacattcaacacaaggaaattgatgccttggttctagcgacacgtgacctcttgagaaaattagacttgaagccttacgatgagaaagaacagacaggacttgtgagaaatattgttgttcgtcgtggtcattattcaggtcagttgatgctagttttagttacgactcgtccgaagattttccgtgttgaaacccttattgagcgtttgacaagccaatttccaaatcttgtttctatcgttcagaatattaatgaccagaataccaatgctatattcggtcaagaattccgtcttttgcatggcagtgaaactattgcagataccatgttgggcaatgaatttgaaatttctgcaccgtctttctatcaagtcaacacagaaatggctgaaaaactctatcagaccgccattgattttgcagaattgtcggcagatgatgtcgtgattgatgcctattcaggtattgggacaattggtctctcctttgcaaaacaagttaagcatgtttacggtgtagaagtcgttgaaaaggctgtccttgatagtcagaagaatgctgctcgaaatgggattgataatgttacttatgtctgtgatagcgctgaatccgctatgcaaaaatgggtggcagatggagtcaaaccaactgtgatttttgtcgacccaccacgaaaaggtttgacagaaagttttatcaaagcaagtacttctgtaaaaccagagaaaatcgtctatatctcttgtaatgtggcaaccatggcgcgtgatattaaactttatgaggaattggggtacaaattgacgaaggtacagccggctgatttatttccaaatacgcatcacatagaagttgtgggattattagaaaaacgcaattagattgtccagtatgctctcctgttttttggcaagcagcttcaaaggaccccaggacctttgaactctcaaatacgcatcatgttgacagttgccacacctacaccaaaatcaaatgccaacaagcgttgagtcgggtaatagcgtaagtagcgcaaggtcatgataagctgctcttccatacttagacggcgtgggcgtcctccttttcggtgttgctcttgataagcgtcagtgagacaatcaagcatcagatgaaacgtcgcttttttacacctatcaacaatttgaaattctctgagtttaattttaagactttttcgtatgttgtttccatacctttagtataccgcctttgagttaccgaacaagtctattgctaaacttgatgaaggttgtattgtctgttataatattggatattgcaagctttaagtgaaaggttttagggaagagattatcacaactcattctttattagttatgagacgatggtattaatgatagtctagtaaaagatttggagaaatgacttccttagaaagttaaatgtaaaaacaatatgaaaaaatacgattatctagttgtcggagcgggtctgttcggagcggtctttgctcatgaggcagctaaaaagggtaaaaaaataaaggttatcgaaaaacgagaccacattgcgggtaacatctatacaaaagaagtagaaggtattcaagtccatgaatatggcgcacatattttccatacttctgaaaaagaaatttgggattatgtgaatcagtttgcggagttcaacagctatacaaacacaccagtcgccaactacaaaggtgagatttacaatcttcccttcaacatgaatactttcaataaactgtggggcgtggtgacacctgctgaagcaggagcgaagattgcagagcaacgagctgtgttgggtggtaaaacgcctgaaaacttggaagagcaagccatctcacttgttggtacagacatctatgaaaaattgatcaagtcctacacagaaaaacaatgggaaaaaccatgtacggagttaccagccttcatcatccgtcgtttgcccgtgcgtttgacttatgataataactactttaacgatacttatcaaggtattccaatcggcggttacacgcagattgtagaaaaaatgttggaacatgaaaatatcgatgtggagacaaatgttgatttctttgccaataaggaagactatttagctacctatccaaagattgtctttacaggaatgattgacgagttctttgattaccaacttggtgaattggagtaccgtagccttcgatttgagacagaagtgttggatatggaaaactatcaagggaatgcggttgtcaactatacagatagcgagacaccatatactcgaatcatcgaacacaaacacttcgaatttggtacacaaccgaaaaccattattacacgtgagtattcgaagacctggaaacgaggcgatgagccatactatccagtcaacaataatcgcaataaccatctatacacagcatataagaaattgtcagaacaacaagagaatgtcatattcggtgggcgtcttggtcattatcgttactacgatatgcaccaagtcatcggagctgccttacagtgtgtgagaaatgaagttggggaatgattttgagaagtcatcaaagtagtaattattcttggcagaagtcggaatgctcttaaaatgttaatcaaaaaaaccagaaattctggttttttttgattattattgaattgctgccaacaggtcagctacttgttgttcgagttttgttagagtttcgtcagataactccaatacacctgttccccatgcttctggattgatggttgaacctgtaaattcaccagcaatctgagtgcgaataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagtcaagaatgcttcagctttttttgccatttgatggttaaaagaaccgtcacgtagtgaaccaactaaaaacaatacgtttgccatgatggcctccttttcataaaaacataaatttagtatatcgtatttgtcttttgttgacaatcctaggtctgctgattcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttctttataacgacagtcatgttgccagaagtgcttaataatttatcaattaagtcttgaatccgcagatttcctttgttgtagagtgcctccatcactccaaactgacaaactgtcagtccgtattttttgattgtttctaattctgattttgcgatagtattagctgctctgcgaaagacgactagactgtgaagtgcatgcttgttctcgtttaaagattgttcaacagttctcatgagaatattttagcaataaatcgttcggttatcaagcaaaaaaagttaaatcctatattcataggtaaagtacttttatggaaaagatagtttttagttaatcaagttcgttttttgaggtaatactaactgtactggaaaaaacgagcaatgagcatttgagaaatagtcttagatggaagtgcaaaactgtgaatgtaggtttttatatccttttctttgtgtgaaggaaaaggaaattttatttatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactatacaatcacagaaagaatggaaatatgctttaatttgtagtataatgggactgttatggaaaaaaagatttttcaactgttggagtggatggcttccaagactggtcagttagtgatgggctcttttatccttctcagtgttgtgactttttcaatttttactatttgggatattgctgctgcccctttcaacaatgcgcgtagtcatgcagttggagtagctacagaatatgctgatttgcaaactgtcaatgatttttctatctacaatggtactgaaacctatttttgtgtatttggtgtcaccagtcagggagaagaggttgcagttttgattccagaggcttctagcacagtatatgtctattctttagctcagggaatttcgcaagaagaagcgcaagctattgccaagaaaaacggtgcaagccaagtagagcgaactattctaggtttaagggatggcaaacctatttgggaagtcaagtcaggtactgcctactatttagttgaatttgaaacagggaactttatcaaacgggagggcttatgagcaagctatcaaaacgtgtcttagaaatggaagaaagtgtcacgctggcagcgggtgcacgggcaaaggccttgaaggcagaaggacgtgatattttagagctgaccttgggtgagccagacttcgttacaccgaaaaatattcaagaagctgctattaagtctatcgaagatggtaaggcgagtttttatacggtagcttcaggtctgccagaattgaaggacgcggtcaatacctactttgagaacttttatggctactctatcgaacgcaatcaagtcgttcttgccactggtgccaagtttatcctttatgctttctttgcggcggtcatcaatcctggtgatgaggttctgattcccacaccttactgggtttcttatgcagatcaaatcaagatgaatgatggggtgcctgtctttgtcactgcaagtgaagagcacaatttcaaggtaacagttgaccagctggaagcagctcggacagataagaccaaagtattcctactcaatactccttctaatccgactggcatgatttacagtcgtgaggaattggaagctattggcaactgggctgtagagcacgacattctcatcttggcagacgatatttacggtcgtttggtatataatggaaataccttcacaccgatttcaagcatttcagaaagcattcgtcagcagactattgttgtcaatggggtggccaaggcctatgccatgacaggttggcgggttggatttgccgttggtaatcctgagatcattgcggctatgagtaagattgtcggacaaacgacgtcaaacttaacaaccgctgctcagtatgcggccattgaagcctttacaggtccgcaagatacggtcgaaaccatgcgtcaggcatttgaagagcgactcaataccatttatcccttgctggcagaagtgcctggttttgaagtgattaagccagaaggtgccttctatctcttcccaaatgtcaaaaaggctatggaaatgaagggctacacagatgtaactgaatttaccacagccattttggaagaagtgggagttgcaatggtgacaggtgctggttttggagctcctgagaatatccgcctcagctatgcgacagatatggacacgctcaaagaagcagtggctcgactacacacatttatgaaaaaataaaaagaggaaaaataatgtctagaaaattgattaccatcaaccaagtaaaagattatgtcggtcaagaagtgaccattggtgcctgggttgctaacaaatcaggcaagggcaagttagccttcctgcaattgcgtgacggaacagccttcttccaagcagttgccttcaaaccaaacttcatcgaaaaattcggtgaagaagctggtactgagaagtttgatgtagcaaaacgccttagccaagaaacgtctgtctatgtgacagggattgtcaaggaagatgagcgttctaagtttggttatgagttggatgtgacagaccttgaagtgattggtgagtcacaagattacccaatcacaccaaaagaacacggtacggacttccttatggacaaccgtcacctctggttgcgttctcgtaaacaggtcgctatccagcaaatccgtaacgccatcatctatgcgacttatgaattctttgaaaagaatggctttatcaagtttgatagcccaatcttgtctggaaatgcggcagaagattcgacagaattgtttgaaacagactactttggtcagcttgcctacctcagccaatctggtcagctttacctggaagctggtgccatggcccttggtcgtgttttcgacttcggtcctgttttccgtgcggaaaaatcaaaaactcgccgtcacttgacggagttctggatgatggatgccgagtattcattcctcagccatgaagagtcacttgacttgcaagaagcttatgtcaaagccttgattcaaggtgttatcgaccgtgctccacaagccttggaaactcttgagcgtgatgtggatgctctcaaacgctacattgcagagccattcaaacgtgtggcttatgatgatgctattacccttcttcaagagcatgaagctgataaagatacagactacgaacacatcgagcatggtgatgactttggatcaccacatgaaacttggatttcaaactactttggtgtaccgactttcgttgttaactatccagcaagcttcaaggccttctacatgaagccagttccaggtaatccagagcgcgtgctttgtgcggacctcttggcaccagaaggctatggtgaaatcattggtggttctatgcgtgaggataactacgatgccttggtagccaagatggacgagctcggtatggacaagtcagagtacgaattttaccttgaccttcgtaaatacggttcagtgccacacggtggtttcggtatcggtattgagcgtatggtaaccttcgttgctggtacaaaacacatccgtgaagccattccattcccacgtatgttgcaccgcttgcatccgtaatacagtcgttcagtttttcctttattacgtcgacgtatgaggaaactccgtttccttatttccaagttcaaataatctcatcattatttgaactcgttttgccgtaccttagtacagtctgcagctcgttgcctagtactaaaagtaaactgaaagactgcgaaataaatattcactgacagactacaaacgtggtctgtttttctggtgtcaattgacattttgaacgaattgttttacaatgtattacaagaagaaagtaggtggaatgatgggaattgtatccttgcgattaaacgatgcagaagaagaaattttcagaagctatgctattcatacaggaaaaagcctgtctgagctattcaaaactgcacttgctgaacagatagaagaccagttggactatgaaattggtatcaaggctttgaagaaattccaagaaaatcctgttacacactcgattgatgatgttcttgcggagttagaagatggcttataagcttgttctcagcgatgatgctttgaagcagttgaaaaaaatggacaggcatgtggggatgatgcttgctaaggatttgaaaaaacgtttggacggtttggagaatccaagacaatttgggaaggccttggtaggagactataaggggctgtggcggtatagagtggggaattaccgtgtaatttgtgatattattgataacaaaatggtcatcctggcccttgaaatcgggcaccggaaagaaatctataaaaaatgaagttctaggtaactaggctcggtatcggtgtacttctcagagttcgtgtcaacatctcagcgcagtggttgattggctttaacagtccagtggagtgaagcagttctgggaactgtttcagcccgagtcttgaagcagaaaagctaggtaaaaaggttggagataaggtttgcgaagcaaatctcagcaattcgtgttttccactccaaatctgacctatacgactgatgcgaactttgttcgccttatctctaacctccaaaggttccctgaaactttggagctatgcgggggtggagagatgaactcctttttgacttatcgagttcttccccactccctgttttctttctttttcactgagttttatttataattattctaaataaaatcgtggagaggaaaatgaagcaagaaagtttaggaaaagaaattattcgtttggccttgcctgctacggtggaaaatatctttcagaccttagttggttttgtggataccctcttgattgcacagctggggctggtagcggtgacagcagttggtcttgccaatacgattttgaatgtctatttggcggtctatatggctttgggagttggggcaacagctttgattgctcggtctattggcgcaggagatagggaatctcttacctttcatgtccgtcaagccttagtgctttcagtaggtgtaggtctgctattggggttactatcccttgttttcgggcggcagatgttggtcttaatgggagcagatgcggagagtttggctggcgtccaggtctttttctactgggttggtggtttgactatttttcaggccttgatgactattttgggaacaatcctgcgggcatctggggatacagtatttcctatgaaaatgagcttactgaccaatggttttaatgtggtcttggactatttcttgatttttggtattggctcttggtcaggtttgggtattgtagggaccgccttgggaactgtcttagctcgcttgcttggtactgtcttgctttaccgaaaggtacagcagactgacttggcagttgatctcaaacaattgttccacttgggaagtcctaaggaaatggtggttttgaccctacctgcagcaaccgaacgcttggttatgcggttgggacaggttgtctatttcagtttgattgtggggctgggaacgattgtctatgcttctcatatgattgcaggtaatatcgagagttttacctatatgcctgcctatggtcttgcgacagcggcggcggttttgatcggtcaagccttgggaaagggggacatcctcacagttagacgggtcgcatttctcagctctgcctatggagtagccatcatgtccctgctcggtaccatcttatttttcggagccccaagttttgctctgctatttaccaaagacctagaagccgtccgtcaagtcgtcacagccttacggatcgatgctttcaaccagccaggccttgcggtttctttgatcatggctggcgctctgcagggcttgggggataccaagtcgccactctactccacaatgataggaatgtgggggctgcgcgtctcaggtgttatcgtcttaggtcagatgttcggtttaggaattgccggcgtctggctgtcgattttgattgacctgctcttgcgagcgatttttctgacttggaggtttattgtgcaaacacgaaaactggctgaataggctagttttttggtataatatcagtagaatgataaaaaggagataatcagatgaaaaccattcacacagataaggcacctgcagcaattggcccatacgttcaagggaaggttgttggaaatttcctatttgcctctggtcaagttcctttgtcacctgaaactggtgaagtggttggtgaaaccattcaggagcagactgagcaagtcttgaaaaatatcgcagcaattttatcagaagcaggaacagactttgaccatgtggtgaagacgacttgtttcctaaaagatatgaatgattttgtagcctttaatgaagtttataaaacagctttctcagcagattttccagctcgttcagcggtggaagttgcacgcttgccacgtgatgttaaggttgagattgaagttattgcagttattgattagaagagaaaaggaggggatgtcatgtcggacaaactccatttagtgattgtgacagggatgtcgggagctggtaagacagtagccattcagtcttttgaggacttgggttattttaccattgacaatatgccaccgactctcttgccaaagtttttagagttgattcgtcatagccaggataacaataagattgctcttgttgtagatatgcggagtcgatccttcttctcggagattcgagaggtgttggatgagattgagggggcagaggatttagattttaaagtcctattcttggatgcgacggatagtgaattggttgctcgctataaagaaactcgtcgttcccatcctttggcggctgatggtcgtgttttggacgggattcagctagaacgtgaacttttggctcccttgaaaaatatgagtcagaatgtcattgatacgacagagctgacacctcgcaatctccgtaaggtaatctcagagcagtttgctagtcaagataatcagccgtcgtttcgcatagaagtgatgtcctttggtttcaaatatggactacctctggatgcagacttggtttttgacgttcggttcttaccaaatccctactacaagttggagttgcgtaatctgactggtctggatgctcctgtctttgactatgtcatggagcatcaagaatcggaagagttttatagtcatttgctcggcttgatagaaccgattcttcctggttatcagaaagaaggaaaatcagttctaacgattgccgttggatgtacgggtggtcagcatagaagcgtagcctttgctaaacgtttggcagacgatttagagaaaaattggaatgttaatcgtagtcatcgtgataaggacagacggaaggagacggtcaaccgctcatgagaaaaccaaagattacagttatcgggggcgggactggtattccagtcattttgaagagtttgcgggataaggatgtagagattaccgctatcgtgacggtagctgatgacggaggatcttcgggggaaatccgtcaggctttgcaggtgacccctccaggtgatttgcgtaacgtcctattggctatgtcggatatgcccaaactttatgaacaaattttccagtatcgttttgcggattcagatggccccttggctggtcatccactagggaatctcatcattgctggtatttcagaaatgcagggttcaacctacaatgcgatgaggttgttgacgcgctttttccatacgacagggcggatttatccatctagcgaacaggccttgacccttcatgctatttttacagatgggaccgaggtagcaggtgagagtaagatttccaagcataatgggatgattgatcatgtctatgtgacaaattcttataatgatgatgaaccgaaagccagtcgccaggtagttgaaacgattatggaaagtgacatgattgtacttggaccgggttctctttttacctcaatcttgccgaatctgatgatttctgacattggcaaagccctaaaagaaaccaaggctgaagtgacctatgtgtgcaacattatgacccaacggggagagactgagtttttctcagatgcggaccacgtggcggttctcaatgcacacttagctgaacaattcattgatacagttttggtcaatattgagccagttccacaagagtatatgaatagcaaccagtttgatgaatacttggtacaggtaaaacacgattttgcaggtttgcaaaaacaagctaatcgtgtgatttcttcgaattttcttcgtttggaaaatggcggagctttccatgatggtgacttggtagtagaagagttgctcaagattttgcaggtgcggccatgagttttacagtacaagtaaaggaagaattgctgcttcagtctagccaaaataagagcgagctatctgctattatcaaattatcaggtagtttgggcttagcttcatcaggtttgactctttctatcagcacggaaaatgcaaagattgcccgtcacatttatgaactgttactccatttctaccagattaaagctgagattcgccatcatcaaaaacctaatctcaaaaagaatcgtgtgtatgcagttttgatagaagacggcgtgaatgagatattgaacgatttgcatttggctgatagcttctttggattagagacggggatttctcccttggttttggaaaatgattcgtggagtcaagcctatcttcgtggagcatttttagcggcaggctctgttaaggatcctgaaaaaggaaaataccagcttgaaatagcttctgtctatagtgaccatgccaatgacctggccaatctgatgcagaaatttcttttggatgccaaagtcattgagcgaagtaagggaaccattacctatctgcaacgtgcagaggacattatggattttcttttggtgattggagcagaagagacgaagacagaatttgagaatgttaaattgcttcgtgaggctcgcaatgacctaaatcgagctaccaatgcggaagctgctaatattgcaaagacggtcaatgctagtatgaaaacaatcaataatattatcaaaattatggatactatcggtctagatcagttgtcaggtgacttgcaggagattgcccagttgcgaattcagcatccagactattccattcagcaattggcggatagtctaacggtaccgatcactaaaagtggtgtcaaccatcgtttgcggaaaatcaataagattgcggatgaattgactgactagataggtatacatagaatgttatggacatttgaattaactttgatacatcgttactttcggcttgccgtactctagtattgcttacacctcagttccttgtctgaaagttaattcattcgacgatactaagactggttcgagaggaccagttttttgtattagttgtgatagtattcctcttcacaggaatgatcctgttttatgaatttttcagtaatgattagcatagaacgttaatatatgttaaaatagatagaaggatactttagctagaaaggagttttgatgataagcaacgaacaatatgattatctaagggcacatccaacttttgaacgtttgacacgtgatagctttgatcaattagctaagcatattcgttttcgaaagattcctaagggacaaatctttttttacgcagaggatcctagagattatctatttgtattgtataagggctatgctcggattgagcaatatgatgagacggatagttttacgtatttagactatattcggcagggtggtgcctttccttttggagatatgtttcaggacaaaccttatcattataccgccattgccataacggacctagagtattttattgtaccgatggtcttgtttgaaaccttgtcgaagataaatccgagtcaaatggcttatatctgtcaaaaattatccaaagtgcttcgttttcaagagttgcgcttgcgaaatgcgatgcgttccaaggcatcagatcgagtcgttcaagccttggctcttctttattgggatatgtgccagcgagagcagtttgctaccttgccatttgaaattcatattcaagagatttcgcgtttagcagctacgacacgggaaacggttagccatgttttgaagcaactgaagcaggatggtaaaatagcttatagccataaacagttaacttatttagatattgattatttcttagaaaatttgacagaaactcattgaagtttctgttttttataaaaaaataaaaattcatataatgatataacggaaagaattatgcagaatttagatgatataatcgataattatttataaataaggttaaaaatgtgaagaatttctcaaaataaatgtgagcgttttcaagtttttgtttttttgctctgttaaactatggatgtaaagaggaaatgagaggcaggaaagcgtacggtcctcctcgtttcccatcatgtataaatctacaaggaggacagatcatgtcaaaccatccaattcatgttttttcagaaattggtaagctgaaaaaagttatgttacacagaccaggtaaggaaattgaaaaccttatgcctgactatctagaacgcctactcttcgatgatatcccattcttagaagatgcacagaaagagcatgatgcctttgctcaagctcttcgtgatgaaggtgtagaagtgctctacttggaaaaattagctgctgagtcacttgttacacctgaaattcgtgaacaatttattgatgaatatcttgaagaagctaacattcgtggccgggcaactaaaaaggcaattcgtaagctgttgatgtctattgaagataatcaagaactggttgagaaaacgatggctggtgttcaaaaggcagaattgccagaaatcccttctgaagaaaaaggtttgacagatttggttgaatcctcttacccatttgcaatagacccaatgccaaacctttacttcacacgggatccatttgctacgattggtaatgctgtttctcttaaccacatgtattcagaaacacggaaccgtgaaaccttgtatggtaaatatatcttcactcatcacccagaatatggtggaaaagttccattggtttacaatcgtgaagaaactactcgtatagagggtggtgacgaattggttctttcaaaagatgttttggcagtaggtatttcacaacgtaccgatgcggcatcaattgaaaaactattggtaaatatctttgaacggcatgttggcttcaagaaagtattggcattcgaatttgctaacaaccgtaaattcatgcatttggatacagtatttaccatggttgactatgataagtttactatccacccagaaatcgaaggtgaccttcgtgtcttctctgtaacctatgaaaatgacacgcttcatattgaagaagaacatggtgatttggcagaacttttggctgcgaaccttggtcttgaaaaagtagaattgattcgttgtggtggcggtgatatggttgctgctggtcgtgagcaatggaatgatggttcaaatacattgactattgcaccaggtgtggtagttgtttacaaacgcaatacgattaccaatgctatcctcgagtccaaagggcttcgtttgattaagattggcggaagcgaattggttcgcggtcgtggtggacctcgttgtatgtcaatgccgtttgaacgtgaagacatctaatgccaagtatagaacgaacaacaatcggttcggaagaatggcaacgcgcagcctctatctatgtccgctataaggtatttgtccttgagcgtggtattgcaaaggaagatgaatttgaccagaatgatacggaagaaagagtttacgccaatctctttattggtgaagagcctgtttcaacgggacgttttcttcctgtcggtcctggtcaagctcgtctaacccgaatagccactctaccgaattttcgtggaaaaggctatggaaaaatgattatcagctctttggaagcgtatgcacgtgaagcaggctttcatcagttgaatatacattcggagttaactgcaaagactttttatgagtcagttggctaccaagcaacttctgaagtttatcaagaagatggagaatggtgccagacattgacaaaatttatttaaacattaggagaagagacaatgacaaacgtatttaaaggtagacatttccttgcagagaaagatttcacacgcgcagaattggaatggttgattgatttctcagctcatttgaaagatttgaaaaaacgcaatattccacaccgttatttggaaggtaaaaatattgctctcttgtttgaaaaaacatcaacacgtactcgtgctgccttcacagtagcatctattgaccttggtgcccatccagaatatcttggtgcaaatgacatccaacttggtaagaaagaatctacagaagatactgctaaagttttgggacgtatgttcgacggtattgaattccgtggtttcagtcaaaaaatggtggaagaattggcagaattctccggtgtgccagtatggaatggtttgacagatgcatggcacccaactcaaatgttggcggactacttgactgtcaaagaaaactttggcaagttggaaggcttgactctggtttactgtggtgatggccgtaacaatgttgctaactcacttttggtaacaggcgctatccttggtgtcaatgtccatatcttctctccaaaagaactcttcccagaagaagaagtagttgccttggctgaaggttttgcgaaagaaagtggagcacgtgttctcattactgacaatgctgacgaagcagtcaaaggcgcagatgttctctatacagacgtttgggtatcaatgggtgaagaagataaatttgctgaacgcgttgccctcttgaagccataccaagtgaatatggaattggtgaaaaaagcagaaaatgaaaatctcatcttcttgcactgcttgcctgccttccatgatacaaacactgtttatggtaaagatgtcgctgaaaaattcggcgtagaagaaatggaagtaacagacgaagtattccgtagcaagtatgctcgtcacttcgaccaagctgaaaaccgtatgcacactattaaagcagtgatggcggctactttaggggatccatttgttccacgtgtgtaataattaactatctaataacgcatcgcaacctccgggggctggcacccagcccccttattttgaggatagatgtgtaagcgattactatttcgcgaaagtgaggaaaaagcaagagatatggcaaatcgtaaaattgtagtagccttgggtggcaatgccattttatcgtccgacccatcggctaaagcacaaaaagaggccttggtacaaacagccaagcaccttgtaaaattgataaaaaatggggatgaccttattatcacgcatggtaatggtcctcaggttggaaacttacttcttcaaaaccttgctgctgattcggaaaagaacccagcttttccactagacagtttggtagccatgacagaaggttcgattggtttctggttgcaaaatgccttggaaaatgaattgctcaaggaaggcattgaaaaagatgtagcatctgttgtgacccaggttatcgtagataagaatgatcccgccttcgaaaatttgaccaagccgattggaccattctatacagaagaagaagcgaaagcagaagcagaaaagactggtgcaaccttcaaagaagatgccggtcgtggctggcgtaaagtcgttgcttcgccaaaacctgtaggaatcaaagaaattggtaccattcgtacccttctcaatgcaggtgaagttgtcgtagcagctggaggcggaggtattccagttgtccaagaagcagatggcaccctgaccggtgtggaagcagttatcgataaggactttgcttctcaatgtttggcagaattggttgatgcagacttgtttatcgtcttgacaggtgtagactatgtctttgttaactacaacaaaccagaccaagaaaaattagaaaccgttactgtggctgaattggaagaatatatcaaacaaaatcaattcgcaccaggttccatgctaccgaaagttgaagcagctattgcttttgtaaacaataagccgcaatcaaaagcagtcattacctcattagaaaacttaggcgctttgattgaatccgatagcggcactatcattgtcaaaggctaagcagctgtatgtatcgttgaggcttctatttattgatgtactctgcatgcaaatatagtttttaaactagacgggttatttattgatggagttaggggagtggaagtgttgatagtcccacaagggttccctttaatctaaacatgaaggtctgggcgtctaagctccctcccctctcatccatttcctatcaagtatctatctataagcaatgatttcagataatagactgaaggagatagacatctcttgaagataggtggatatttgatacggttattacggatacaatttcccttaaataggggataaacttttaaaatattataggaggtttttgcgatgagcgaaaaagtgaaaaaaggctttaaattgccttcgtcttatacaatattgatgctcattattgcctttatggcagtgatgacatgggttattccagctggtcagtatcaggttgatgaagccggacgtttggtggctggtacctatgagaaggttgctcaaaatccacaagggatttacgatgtttttatggctccagttcgtgccatgcttggtcacggtgcgactgaagcagcgattaacgtagcattcttcatcatcatggttggggcctttcttggtgtagttaacgaaacaggtgcacttgatgtagggattgcttctattgtaaaacgcttcaaaggtcgtgaaaaaatgttgatttacatcctcatgcctttgtttgccttgggaggctcaacctatggtatgggtgaagaaacaatggctttcttcccgctccttgttcctgttatgatggcggttggttttgatagtattactggtgtagccatcatcttgctaggttctcaaatcggctgtttggcttctactgtaaacccatttgcgacagttgtagcctctgacgcggcaggtgtaagtgttgcggatggtatgatttggcgctttgtcttcttcgttgtcattctcgcgatgggggttctctttgtagccaactatgctgagaaagtgaaaaacgatccgactaagtccttggtttataaacaacgtgaagcggacatgcaacactttaatgtcgcagcaactcaagaagtgaatgcagaattatcaccagctcaaaaacgtgttctctgggtatttgtactaacatttgttctcatgatttgtagctttattccatgggaagatttgggtgtgactatctttacacaatttaatgattggttgattggtcttccattcatcggtcaagtgattggttcttcaacagctgctcttggtacttggtacttcccagaaggagcaatgctctttggtatcgcagggattgtagttggtttagtttatggtatgagtgaagaacgtttggtaaaatccttcatgttcggtgcggctgatattttcagcgtagctttgatttgtgctatcgcgcgtggtattcaagtcatcatgaacgatggtatgattactgccactattctccacatgggtgaagaaggattgcaaggtttgtcttcacaagtattcatcattttgacatatctcttctacctaccaatgtccttcttgattccatcttcatcaggtcttgcaggggcttctatgggtatcatggcacctcttggtgagtttgtaaatgtaccagcgagcttggttatcacagctttccaagctgcatcaggtctcttgaacttggtagctccaacatcaggtattgtaatgggagccttggcacttggtcgtgttgaaattggtacttggtataaatttgtaggtaagttaatcgtaggcatcatgattgcctccatagctattttggtcattgcgacattcttctaatcgaaattctgggtcagattttatcacgaatacagataaaatttggctcagtttttccttttatgatagaatagtgctagaaaatatatcatatcttattatgttgaaaggggacacaatgagaacaagttttattcagtcatcgcatcaggaggcatgtattcaagccatccaagaactggttgcttttccttctgttttgcaagaacatcaggcagatacgccatttggtcaagcgattcaggatgttctggagcacacgttggctttgacggaaaaaatgggttttaaaacttatttagaccctgctggctattatggctatgctgaaattgggcaaggcgaagaattattagcaatcctttgccacttagatgtggtacctgctggtgatcttagtcaatggcagacgccgccttttgaggctgtggtagagggagattatattattggacgcggggttcaggatgataaaggtccttcgatggcggccttatttgcagtaaaagcacttcttgatgcgggagtccaatttaacaaacggattcgtttcatttttggaacagatgaagagaccttatggcggtgtatgaaccgctacaatcagttggaagaagtggcaactatgggctttgcgccagattcttccttccctttgacttatgctgaaaaaggattactacaggccaaattgcatggtccaggtcacccttgtctgagtatcgaagctggaactgcctataacgtagtacctgccaaggcaagctattccggtcatttattagccggagttattgcggaattagatcaattaggctttgattatgaaatcaaagatgatcaagtaacggttcttggtatttcgcggcacgccaaggatgctgccgagggggtcaatgccatcgttcgtttggcaaaggctttggaacatttcgaaaatcatccagccttggactttatcgtcaatgcagttggtgaagatgccacaggatttaagctttttggtgatgtgaccgatgaaccatcagggacactcagtttcaatattgcaggtctaaccattagcgcaaaaaaatcagaaattcgcttggacattcgtattcctgtcactgcggataaagaagccctagtttctactttacaagccaaagcgcaatcatgtggcttgacctatgaagagtacgactaccttgcttccttgtatgtgccattagacagtcaactggtatctacgctcatgtctgtttatcaagataagacaggagatttgacaagcgagccaatctcgtcaggtggggctacctttgctcgtactatgccaaactgtgtggcttttggtgcatgtttcccagatacagaacaaacagagcatcaggaaaatgaacgcatgccattagaagacttatataaaacaatggatatttatgctgaggcagtctatcgcctaactgcggaatagccattatcagcattgaatagtaaattacagtttaaaagctcttagtgaaatatctaagggcttttcttatgaagaatatcattaaaaagatgagagagaaatgtgtcactgtttacaagaagtggacaaaaatatatgaaagtgtgacttattatatgctgttttagaaatagaccccatctgcatatagaataagtcaagttggactattctacaataaaacgcttacatgttatatttgtgacagaaatgcgatcgcacatcaaccagtaaactgaattttgagtcttgtacgagactaaataggtttacaaactgctttattttggctataggtaggataaacttgcagactttataggaggaaataatgaaaaaagaaacaagtaagtttacgaaaaaagtcatccttggtcagcttctcatctgtaccagttttttggtatgggcagggcagactgttgcagcagaggaggtatctcagggagaaccagtagcaatcaacaatgaaactccacctgttattgaagcaaaaccacttgtagaagctactccatcaactgaaacagaaccttcaactccagaagaaaaacaggaggaaccacaagtagctggtaaaaatgtggtagaagggaaaaagccagtaaccaacagccagcatcagatggtttctgaattatcaacggtcccttctgtttctataaaaaatccagatgcagctaccgatgggagtgcttacggtagtagcgacgatgccaatagcaataccaaaatcattgctggtaaagaaactggcgaaccagataacggttactccaagtgggatcatgtttacgttcagtatgattttgaaaaggaagttcccgtccatactgtaaaaattcatcgtaatacttatgacaatgcagtgtctacttttaaagatgttaaagtggaattgtctacaagtgcagatttttctcctgaaaccacagaagtcattttcaaacaggcagatgtagaagaaacaattgcaaataaaggacagcctcaagtcatccaattaccagcaccaatcaatgctcgttatattcgtatttggggacgggggcattatatccaaaatacaaacagttcctggaagggatatagtaatggcgttctctttaacgagatagaagtcttggcgcaggttgaagcagatgctggtacgaatgaagaaccacaaaccgagctagtcaacctcgctaaattgaaaaaaccatatttctatggtaaggctccaactaatccagaagccattaacgatggaaagttcgacgagaattatactactcaagaatcaataggggataaagcttatcttcaatatgaatttagaaatgtctatactattgaggaaatcaaggttcagttagctcctggagagtatcgtaatttccggatagatttggatgatgattataatgatggtaataattataatacaatctataagaatgaaaatttcaccattgacaaggaacagattataacaattaaaactccgaagaactctaaagcgcgttatgttcgctttagaggtacgcgcgtagatgatactcctcttcgatattcagaaattcagattatgggacgaggaaaatcttatgacgaatctgctccagaatatgttccaccaaaatctgaatacgatacattagtctggtctgatgaatttaatggcgacaagattgatgaaagtaaatggcaaattattgatggcatgtggaatcatgcggctatatacaatcgtaaagcagtttctatcaaaaaagatggcgacaagagctatttgtctatccgtagcacgaaccataaggataaaaaaactttggttgaagcagttgggcacgatcggtatgatgataaagaattaccagataaagtaacatggtcttctggtcgcctagaatctaaagataagtattctttccaatttggtcgaatggctgttcgagctaaggtaaatgactctaagggaatctggcctgctatttggatgttggcacaggatgagaccgggcatgacgaaattgacgttttggaataccttggtcaaaatccatggtatgcatggacaactaaccattttggtattttggcaaaaaataaaaaatctgatggctcagcttataagaattacgaagcttggagtcaggaattccatgtctacgaagtcgaatggactccagatgtcatcaaatggtatattgatggaaaatttgtttttcaaacagaccgtggtaaggatcgggatggtatgcacacccgccctatgttcccgatactggaaacccaagttggtgatggctgggttggtgatgttgattacaaacgcaacatgactaaacaggatagtgagtacttggttgattgggttcgaatttatcaaaaagcagatcaaagtaaggtacgttttgataatctagatgatgccaagcctaatgattatgttattaagccgcagcaaaaacttggtcacctcgtaacagtctctaacgggaaagcagctcatgaaaacaaaaataatttctactatggaggtcaaccacgttacgaaacaagcaggctctatgctgatggtgatggcgaaaatgcactagtctacaagattgctaatccagaggctttgcacttaacgacttattacaaaacacttgaagactattctgtctataataaagaagcaggggctaatgaaggaaaatctgttcgcaaacatttgataaatgcaaaagacggtgaaattgacttcactgtgtattcatctgttgacggcaaaagctggaataaagagaatgttactgtagtggataattttgtagaagcaaccccagcttatgcacgcactacatttgatattcgcaacattcgaaaaggtactaaatttgtgaagatcgtctttccaacggttaaaggtatttcctataagttggaagatggaacagagaaaggcttgcaagccagtgatgtccagttagcaaaagtaacttttgtagctactcatcctgaagcagaaccagaaaaacctattgttgatcaagaaaaactagccttgtccaaagttttttcactcgatgccggtcgcaagtatttctctgtaaatcagataaaggagattattgatttaatttcttcttatggttacacggatatgaacctcttattgggaaatgatggtctgagatttttattagatgatatgaatttgaccgttggagataaggtgtatgacagtgaagcagttagaaaagcaataataaatggtaataagcattattatgacgatccaaacggtacaaccttaagtcagagtgagatggatgatattcttgcttatgctaaggaaaaaaatatttccattattccaactatcaatagcccaggtcatatggatgcgattgtagaagcaatggaagaattggggataaaatcgccaaaatttagttataatggcaaaacatctgcacgtacagttgatttaaaaaatgaccaagcagttgcttttactaaagccttaattgataaatatgctagttactttgcaggcaaatctaaaattttcaatattggcttagatgagtatgctaacgatgctacaaatgcttctggatggcacattcttcagacacaaggtgattatggtaagtttattcaatatgccaatgatttagcagctatcgtcaagaagcatggtttagagccaatggctttcaatgatggtatctattataaccacgatactagttcgggtacttttgataaagacattattgcttctttctggacaggaggttggggaggatatgatgttgcttcctcaaaattccttcatgaaaaagggcataaaattcttaatacaaatgatgcttggtactatgttattggacgtgaagcagaaggtttgggatggtataaccttgatcaaggtcttcgaggaactaaatctacaaggtttgatcaagtaccgaaatctgagaatactaaggtacccattattggtagtatggttgcggtatgggcagatgacccaagcaagccttacagctatgactcaattaaaaaacttttgcacagttttacggaaaacaattctgattattttttggcagagtaccgagatttgcgagaagaagttgggaagattcctactgatttaaattcctatacaccagagagcgtggcgactttaaaagaggtcttgaacaagattgattggaaactaagtagaaataaccaagcgtttgttgatggttacttggcagaagtaaaagcagcgcgtgaagcgttagttcctgtgacagcaaagggagacagcgtcaaagcggagcccttaccagaaggcaagctacctctgattactgctaaaggaaaaagtgtccaagcagaaccacgccctgcctttaagggatacctgacatcaaactatggaccatctgtcacacctttatccctcgtatcaaaaccaagcagtgagcagtcaaattccaagcaagcagcttctcagaagaaagaattgccaaatacaggagtagtagatggtcttggattctctctccttgggatgattggtctggcatttgctagtcgccggcggaagaaggagtaatgtagccacttgaattaaggttcagggctttctaattgtaattatatagttatctagtttttctttcactcgctttgctgtacccaagtatagcatgtagcttattgccttgtacaaaaagtaaactagaaagctatgaataacaggataattttttatcggctactaaaaatcccccgtaataaatcttattacgggagattttcgtttatgagtataaagggaagttattgatatttatttgaaaaattatctttaaaattaagtatgttgtttgtgaacacaaatttttataatttactaaagaaaaatggtggagtaaactgtttcaagtgctcgaagcaagcttgtgccccctcgacatcttcacaaatgatgagacagacatcgtcaccgcagacggtcgctacaatttgaggaatttccatggcatccaaaatagaaccgaatgagttggccaatccaggtagggtcttgagcaccacttgatgttggataggttttagcatgaccaaagcatcttccatatagagtcgcagtcgtttttcccagcgagtaggagcaatggggttgatgacatagtgagaagaatcatcttcgttgactttgacaagattgagcatcttgatgtcacgggagagggtagattgggtgacggagactccgttgacctctagtaattcttgcaattcctgctgggtatgtattttcttctccatgattagagataggatcagctgatggcggctttcaatcttgttcatagggccctccaataaaatcagaattcagaataatttggtgataacagcctattgaatgaacattgcatccccaaaactaaagaagcggtagcgttcttcaacagcatgtttataggcatctaaggtaaattctctacctgcaaaggcagaaactagcataaccaaagtagattttggcaggtggaaattggttgagaaggcatcaacgattcggaaggtgtagccaggtttgatgaagatatttgtccaaccagaatcagcttgcaaacggccatcaaatttattaccgatggtttcgagggtgcggatggatgtcgtgccgactgcgacgatacgaccaccgctatctttgacctgattgagggtttgagcagcttctgctgataggttatagaattccgagtgcatttcatgctcatcaacgttatcaacagagactggtcggaaggtcccaagtccaacgtgaagagtcaaatagactagcttcactcctttagcttcgattttttcgagtaactcttgggtgaaatgtagtccagcagttggggctgcggcagaaccgttttccttggcataaactgtttgatagcgttcacggtcttctaatttctcatgaatgtaaggtggaagtggcatttcgcctagactttccaagacttcaaggaagataccttcataggagaattcaacaattcttccaccgtgctctaattcttctacgatagtagcagttaatcgtccgtcaccaaaagcgactgtggtaccgaccttcagacgttttgctggtttggcaagaacttcccactgatcaccttgggtatttttcaaaagcaaaagctcaacatgtcccatagtttcaggcttgtagccatagagacgggcaggcagaacacgcgtattgttcatgaccagagcatcaccgggattcaactggtcgatgatatggtcaaagtgactgtcaaccatgctccgtttttcgcggtcgaggatcaatagtttagagctgtcgcgcttttcaaggggtacttgagcgataagctcttcgggtaaatcaaaatcaaaatctgcagtattcatattcactccttagactaaaataaaatataggtaaaataaatcaatagggcaaatggcaaagccaccaatagaccaccaatcaggtagaaaataaactttaggacctttgatttagaaataaaatagccagtaaggcagaacagaataccaataaaaaataagtaaaaaagcacatctgtcataaatgtattatatcatagttagacacttaagtcttgatggatgggaagagaattaaaattattcgtgctgatgtaatactctataagtataaattcttgacaaaaattggtctataccatataataaagaaaaacaaaatggtatagaccaaagaggtgtgttatgaaaattcatgtagtaaacaatcaagttgaaggagcaactgtagcattagacattttgagagaaaaattgaacggaggtaccaaggtattaggtttggcaacaggctccagtccgttagaattttacagattgattcgtgagtcggatttagacttttcggatgtgacatctgtaaacttggatgagtatgttggtttaggtgaggagagcgaccaatcctatattcattttatgaaggaaaatcttttcaataccaaaccgtttaaacaatcttatttaccgaatggtttggcgacagatgtagttgctgaaacagaacgttacaataaaattttggctgaacatccggttgatttccaaattttgggtatcggtcgcaacggccatatcggtttcaacgaaccaggtgctccatttgatggtcagacccatctggttgaattggcgccatcaaccattgaagccaacgcccgcttctttgacaatccagaagatgtaccaaaacaagctatctccatgggcatcgccaacattatggcagccaagaccattgttctcatggcctatggtcaggaaaaagctgacgccattaaggcgactgtggaaggggcagtgacagaagatgtcccagcaagcgtcctccaaaaccatgacaatgtcatcctcatcctcgaccaagcagcagcgagtaaattagtgtagtatgttgtaaacgattattcttagacataaagttggttgtaacagtacaataagtataatttctgaatgaatctaggttctttttccattatgaatttgacaaaaattgtgaaaaggcatgtaacttatatttttaagggcatgccttttgctattctgataatccatatcagttgttatatatttgaatggattatatataacattaagttggatgtgagagaaaatttcaacaagaggtattgccatcctttatcatgttgaaaattgatagggataagtgaaatgggcgaaatagtatcattttctctacgttttgtataacgttttcaattttttcaggtagttttctggtttttatataatctttttctaaagttggtttttgagttatttttttgtgctatactgttactacgtttccgataggaggaagcaaatatctatacaaaggagatgtttcatcatgaaacatattgtaacaaaacgtaattataaagttggcgcatgcgctatggcacttgcattgttgatgactactgcaggtggtgcagttgtaaatgcagagcagcaccttgagtcatcagttggcttagtacagcgtggtgatgtacttctaaaattgaaagaatcaaaccagtctttcaatgaaggagaggttggaaatttagagcctgtcaacccaactgtgcctccaatggcttcttctgtacaaaaatcatggtttagttcattttggggtggtgtaaaaacattctggaatgcattatgttgttctgtgggactaactgggctcaaagttagtaagtaacatagagttataatcttgtaatatttagttaattaatttgcaaatccttcatacttcactagctttcttaaattatttaattttctatatattaccctcttagaaatctttttcatctatacattcataactttaataatataactcgaattagtatgccctctatgaaaatagagggttttaaacattttttctttattaccacaattattcgatacaagttttttgaaccataaatataatattgcatgtgtatttttgttcttgtgttaatatgcatatcttggagttttatagttttttatctaacctttttctaaagttggaatttgagttgtctgtttgtgctatactatcatttgtagagacgaatatcgtataaaggagatatttcaacaatgaagcaacttgtaacaaaacgtagttataaaattggtttgagtgctatggctttggtcttgctaatgaccactgcaggtggtgccactgcacatgcaagtacgggtacctatagtgtcgaaactcgaggtgatgccaaagtgtataggctgttggaaactccggcggggtcttttacacaggggggcatagttttgaaacctgtgaataattctacaactaaaccatctgaaaccaaatcatggtttgattctttttggagtagtgtaaaaacattttgggaagcaatctgtcgtggagttggatggtgttaagtagaatgtttactatttagagttatattcttgtaatatttagtcaattaaatttgcaaatccttcataccttcattaatctttcttaaatttttaattttctataatattaccctcttaaaaatctttttcatctatacattcataactttaataatataactcaaaatagtatgccctctgtgaaaatagagggttttaaattttttagggatattcttttttattacttcgcttattcgagacaaggttctcttgaaaggagcgtatcctatttcctagtttttatattaatatttttattttttggaatttaatggttttttatctaatctttctctaaagttgggatttacgttatttttttgtgatatactggcactacattgtctaaaaaagggcgaatattgtataaaggagatatttcaaaaatgaaacgtattgtaacaaaacgtagttataaagttggtctgtgtgctatggctcttgctctgttgatgagcactgcaggtggcgtaactgctggtgcacaggggcataattttacttcatcagatagctctgcaatgagaaatactcaggtgcttgttaagggaaatacatcaaatcggagttctcatgatggtccagtaaaaattgcgatgccgagagctgctggttctaaaaaacaaaaaacttggtatgaatctctttggagtaccattaaaaagttttttgaacaacttcgtcatggttttcatttagaaagactgtttaaaaatggatagtaattcagttttgatttattaatctattaataatcttataacatttagcgcaattaatttataaaccttcatattaaaaaaactaatactttgtaaaaggagacatttcatgaaacaagctaattcaaaactagtagctttaacactcattacaactctcgcagttacctctgtgattgcgacaacggtgcatgctgaagagaaagtaactgctgatcagactgtagcaggaaaacacaaaccgattacgggtgagcagcttcaaaaagcgattggagatagaaatccaaatagtattcagatacaagctaaatttgaaaataccaatttcaaaaatcaaggaataacttttattggaaaagctgaaattccatctaaatcttctgaaaagtcttcatggttttgggaactttggactcgttttacaacttttgtcaaaggtatttttagctaaggtttctatttttcgttgacttcatatggatagagaacagtggttcatgtgagcttttattcaaatgaaaagcgtatgaaatattggagagatctaggcatctaaactagagattgtgcaagaaattatgtaatagacctcacattttttgcgaatgagatgttgacacgaattccatatttcttgagtctcagttgtaatttttcttagataaattaaagagtgaaaagtttaggatgtaattgttctaaactttttatattgcattgataaaaaaatacagtctttgtgtaacaggtatattcttgtattttttagtgaaaaaagaaataaattgacaaaattatggtaaaatataggttgatttaaaattaatcatctaatgaatggaatgagttcgaagtaagtcaagattgactagacattgtatttaaagcaattcgcaggaataagagatggaaggagatagaacatgcaacatccagttgtacgatttatctgtagaaccctgttctatttttttatattgttactacttttgtatctgtatagttatttagacattggacagggaggatttatctataatgagttttaaagaggagagtataaaaatgattagcagtatgttagagcgggtagagcattttgcgacagaaaatcctgactaccctgtttaccattatctaggacagttgtatagttatggggatttaaaggcagattcagattctttagcagcccatattgatagtttggatttaccagcaaactctcctgtccttgtttttggcggacaggagtaccagatgttggcaatctttgtagccttaaccaaggctggccatccgtatatccctgtagatagtcattctgctttggatcggattgaagctattctggaaatagcagagccgagtttggtgtttgcggtagcagactttccgctagagacaagtttgccagtgcttggtttgtctgaagttgaagccatttttgagaagaagtcgacttatcagttgatacatcctgtaagcgaagatgatacctactatattatcttcacttctgggacaacgggtaaaccaaaaggagtgcaaatttcgcatgacaatttgctcagctttactaactggatgataagggataaggagtttgcgctaccagagcgaccgcaaatgttagctcaaccttcctattcgtttgacttgtcggttatgtattgggctccgacgcttgcccttggtgggaccttatttgctctaccgaaagagttgactttggattttaagactttatttgcagctattcaaactttgccatttaagatttggacttcgacaccatcatttgtagatatggctttgctatctcgtgagtttgatggggaacatttaccagatttgacgcatttctattttgacggagaggagttaactgtaaaaacagctcagaagctccgcgaacgttttccaaaagctgtgattgttaacgcttatggaccgaccgaagctacagtcgccttatcagcagttgccatcactgatgagatgctggtgaattataaacgtttgccgattggttataccaaaccagactcgccaacttttattttggatgaggatggtcaagtagtaccgaatggtcaacagggagaaattgttgtatcaggtcctgctgtctctaaaggatatttgaataatcctgagagaaccgaggcggcatttttccagtttgacggcttacaggcctatcatactggggatttgggtgtaatgacagatgaaggtctgttactctatggtgggcgtatggatttccaaattaaatataatggttatcgtatcgagttggaagaagttgcccaacacctaaataaatcaacctatattgaggctgcggtggctgttccacgttataatgctgaccataaagtgcaaaatctgttagcttatgttgtccctaaagcagggattatggagcagttcgatcgagagttggagttaaccaaggtcatcaagcaggagttaaaagaacggatgatggattatatgatgccttcgaagtttatttatcgagacagtcttcctttgactgcaaatgggaagattgatattaaggggttgatcgctgaggtgaatgctcaatgatggagttttttaaacagctacctcagttagagccttatggaaatccattgtactttttctatctagtcttggcgctagtaccaatttttataggactcttttttaaaaaacgtttccccttgtatgaaacaggtgttagtttagccttcattgtcttgatgtttacaggtacaaagacaatgcaattgctgtctttattggcctatattatttggcagacaatgttgatttttttctacaagcattatcgtcaacgggcaaatcaaagctgggtcttctatctaatcgtgtgtttagctgtttttccgttgacttgggtaaagttggcaccgacttttagtcagcatggggcaattttcggttttttaggtatttcttatttaacgtttcggtcggtcggaatggtgattgaaatgcgggacggtttactaacggaatttagtttgggaagttttttgcgatttttgctatttatgccaactatttcgagtggccctattgatcgttatagacggtttacggaagattacaaacaaattcctgagcgaactgagttattaaatatgctcgatcagactgtgcattatattatgatgggcttcttatataagtttattctagcctattttatcgggcatactttactggagcctttaaaggcagtagccttggatcaaggtggatggtttaacttacctactattggagttatgtatctttatggttttgaattattctttgactttgcaggctattccatgtttgccataggtatttccaatcttatgggtattcgctgcccaattaactttgatcaaccgttcaaatcgcgtgatcttaaggagttttggaatcgatggcatatcagcttatctttttggttccgtgatttcgtcttcatgcgtctggttaagactttgttgaaacataaggttttcaaaaatcgaaatacggtatctaatgttgcctatctgctaaatatgctcttgatgggcttgtggcatggtgtaacatggtattatattgcatatggtctctttcatgctttggggttgatcatcaatgatgcttggattcgtaagaagaaatcaattaatttagctcgaaaaaaagctgggcaagaaccattgccggataatcgttggacgagtttcgctggtatgtttgtgaccttccatacggtcatgttctctttcttgatattttcaggatttttagataaattgtggttcaagtagacaataggtaacgattgtatgaatcgtagaaaggaataaaaaatggatgtaaaagaaacaatattgaatattatcgaagaattatttatggaagatgtatctgaaatgatggatgaagacctatttgatgcgggtgttttggatagtatgggaactgtagaacttattgtggagttagaaagtcgttttaatattacagttccagtttcagagtttggtcgtgaagattggaatacagctaacaaaatcatttctggtgttgtggagttgatgcatgcgtaagcaattgtggcagatttttggacctgtgatttgtgcaacgtttttagttattctcacgttgttgtttttcccgagttcttctcggtcaaatttcaaagaagaaaaacaagatgcagtagcattgtcttatattagttttaagagcaaatataagaaaaatagggctctgggagataaaaatcatcgttttgttcctttctttgggtcaagtgaatggtcacgttttgatagtatgcatccgtcagtgttggcagatgcctatcagagagagtatactccctatttgttaggacaacgtggtgcagcttcgctgacacaatattttggcatgcaacagattggggcacatttaaaaaatagtcaggctatctatgttgtttctcctcaatggttttcacccaaaggggcatcatctaaggcatttgaacaatattttagtagtgatcaagccactcattttctgcaaacaagtgctaaggatgactatgatagatatgcagcaaagcgtttcttagagcttaaatcagactgtagtttgacaggaatgtttcaaaaagtagctagtggtaaggaattgtcgaaatgggatagagagcagttgaactggcaagcctatttattagaaaagcaagatgccttatttagtcgctttgctgattctggtagtaatttaggattggtagaaacggaagcgatgaaacttccagagactttttcctatgaccgcttgagtaaagtggctaatgaggacgggagtcgttctactcaatcaaatgatttccaaattgatgataggttttatagaaatcgtcttcagtcaaaaatcaaaaaactcaaacaatcccagacaaaaatatcttatctgcaatcaccggagtacaatgattttcagctggttttgaatgaatttgctaaacatcagactgatgtgctatttgtaattcccccggttaatgaacgttggatgaactacactggtctcaataaagatatgtatcgggcaacagtagcaaagattaagtaccagttgaccagtcaaggtttcaatcatattgctgatttgtcggagcagggggggatagattattttatgcaagatacgatccacatcggttggcaaggctggctggagcttgataagtatgtccacccattcttgacagaacaacaagcacctgttcattatcagttaaaaaaagaatttttaacttccgaatgggctgcatataagggagatttaaacttatttttgaaatagttagatacagttataataaaaagcaagaaggctttgaattaggaagtctccttgcttttttgttcttttactgtaataaactgaatgattacatatcttctcccaacaaactgtggttggctttgccgaagcgaataacatgataggcaaccatagcgtgtgagagcaggtttaagataacaaatagtaggatatttgaatgaccatccagcaataaggcaacatttccaattagtaaaatgagagcatagatgaacagccctctcctgccaacttgatggacttgttgattatagaaggaggtcgaaaggataccactatagaagataaggtttcctacaatcagcatgggcaaggccaaatcattatgatgactagggaaaagctccattgccactgtgaagaaattcaagccaagaacaattaccaagtgagcgtatagcagaacagtcgcatctgccttgcggtgatggtcgatagtgagataggtttgagaaatatagaagatgaacagagtcgccattgcgaagaagaggaggattccttccaaaggaagttctagaagcgggtaatttttgataatagctatgacgatctcaccgaaagtgataatggtaatcagctggcaacgttccaccatgtgtgggaagttgatggggtcatgactcattctcttttggaagaagaaggaaatcaagaagggaataatatagacaatcagcatccgttcatcattggtccatagcttgaagatgaccaacaaggttgcaccggcaaagacaacaatataagtcgccagcatctgcaaggttgccttgatgtcctcattaaagccaatccgtcttcctcttaagtaatattgtaggagaataatgacataagacaaggttaaaaaggtgttaaatggcagagctgtttgtgcaaaatcgttgctaaaattaagtgacatatttccaatcagatacatggatggaataatggtgaaaatatccagaaaatcccgttcgccgtatttattgagatagatggtttcattcatccacaaggtcataataatcaagtttgtagtgataaatgttgtaacttccttgaaaccgatgtggttcccatgtagcaagccagtcagtgaagaagtggccaggacaaagaccagatcataaaataattcataattggaaacacgttttgctgtaatttcagacatgtcaatctccttttaaaaaaatctgaaatattataccatacgaaaagggaggatgtcatctctctttatatcttatagtgtccagtccaagtctggtccgactgggacaatacctgttgggttaatggttttgtggctaccgtagtagtgctgtttgatatggtcaaagtcaaccgtctctgcaatgccagcatggttgtaaatccgtttggtataattccacaagtttggataatcaaccaaggccttgatattgcatttgaaatgcccaaagtaaacaggatcgaatcgcaccaaagtggtaaagagtcgaatatcagcctctgtcagctgattgccaaccagatagttcttatcagccaaatgctcttctagtttatccaaggcagcaaaaaggttcttgacctctttttcatagactgcctgactggttgaaaaacctgccttgtagactccgttgttgatgtttggatagacaaaatcattcatggcatcaatctcggcttgcaggtttgctggataatagtcatcgtaatttccagtaatatcattaaaagcagagttaaacatgcgcatgatttcagccgattcattgctgacgatggtattggttttcttatcccacaagacaggcacggtcacccgaccagaatagtgtggatcagccttcaaatagacctgatagagataatcgctgttaaagagggtatccttgataacaccaggaccatcttcaaatgtccagccattttctaacatgaggggatgaacgacagacaaggaaatatggtcttccaagcccttcaattttcgcataatcaaggtccgactagcccaaggacaagccagagaaatatagaggtggtagcgaccagactcagccttaaaaccaccctctcctgttgggcctgcctgtccgtctggcgtaatccagttgcgaaattgtgtgacgctacgaataaacttaccgcctgttgacttggtgtcataccattgatccacccatttgccatcttgtaaaagtcccatgaattttctcccttactgaaaaaatgggaaatccaataggatgattggatttcctttgtaaaaaaatatatcactaactagtattataaacttttttcaaaaagagtcaagctatatgatttgtgataaaatagtcccatgagattggacaaatgtttagagaaagccaaagttggctcgcgtaagcaagttaaaaaacttttcaaagcccagcaaatcaagattaacggacaagcagctcaaagcctaagccagattgttgacccagagttacaaactatccaagtttcgggtaaaaaagttgccttagaaggttccgcctattatttgctccataaaccagcaggagtcgtttctgccgtgacagaccaggagcatcagacagtcatcgacttgatttctccgcaagacagtagggaaggtctctacccagtcggtcgcctggacagggataccgaaggcctagtcctcattaccaacaatggtccgctcggttatcgcatgctccatcccagccaccatgtggacaaggtctactatgtggaggtaaatggatgcttggctgaggatgcttcaaaattttttgcctcaggtgttactttcttggatggaacacggtgtcagcctgcagatttgactgtcttggaggcttctttggaccatagcagagcgaccatcaagctggcagaaggtaagtttcatcaggtcaaaaagatgtttttagcctatggtgtcaaggtcacttatctcaagcggatttcctttggtggttttgaactgggggatttggaacgaggtacatacagacaactcacaccaaatgaaatggaacatttattcacttattttgactagaggaggatatataatgagcatttatgattttacagtacaaaaacaagatggcacagaccagtccatggctgagtatcaaggacaagttttacttatagtcaatacagcgccaggttgtggattggcaccacaatacaaggaactacaggagctatatgatagctataaagacaacggttttgtagtgttggatttcccttgtaatcaatttttaaatcaggctcccggttctgcggaagacatcaatcagatctgtagcttgaattatggtacaacttttcctcgttttgctaaaattgctgtgaatggatctgaagctagtccgctatatcgctatcttaagaaagaaaaatcaaccttattaggaggtcgaattgagtggaattttaccaagtttttggtggatagacaagggcgtgtggtcaaacgatatttaccaacaactagtccattaaaacttaaagaggatattgaactttacctagaaaaataacaagaaggctggagtcatctagccttcttgttttagtaaccacagaaaatagggagcgccgataagggagacaatgatgccggttgggatgcctgttccgacaagtagtactcgtcctatggtatccgctagaagtagaatgaagcttcctattatcatagtagctggaatgatgacacgatggtcatttcctaaccatttgcgcactatgtgaccagcaatgagaccaacgaaggtgatattaccaactaaaatgacactaagagaggctagggcggtagccaatatcaaggtaatccgcctttcacgctgtaagtggagccccaaagccatggctgtctggtcgtttagattcataatattgagtgagcgacttcgactaaacgttgccatccacaccaatagaagaagaggagtatagattgcgatagttttccaatctccaccatttactcgaccgctgagccactggacaatgtattccatcttaaagtcatctaattggctgatgatgctgaccatgataccagacagcatgctcgaaattccaactcccgtgataattaagcgtgcaggatggataccgtacagcttcttacgtgcaatccagtaaactagaaaaatggttaatccaccgcccatcatagcaaatagaggcatgagactcaataagacagggctgatttttgaagagagaccgacaaatagtgccacaacaagaccagctcctgcgttgattcctaatattccagaatctgccagaggattgcgggtcaaagtttgtagcaacaaacccgccaaagccagagaagcccctccgataatggaggcgattattctaggtaagcgaattcgtccaatgataagtagagtcgatgaactggcacgcccactcatgatgtcgatgaaatccgaaaaggatgaattgctatagccgatagataaggaaagtaggaaaatgataaataaaaggattagcaggaatgtgaatatttttagatagttgtgatgtcttatcaaaagtgtttctcctttctaatcaaccataggaagcaagggagaccaatgatactgatgactgcgctaatgggagtttcaacaggtggattgatagaacggcaaaccaaatctacccagatgaggaaactagcccctgcaaaggcagttaatggcaagagtagcttgtaatttttccctgtaaacatgcggataaagtgaggaataatgagcccgataaaagaaagtgagcccacaagagctaccgcagaagctgagagtagaaggacaattcccaacaaaaccaaggtcatcagtaaggttcgttgacctagatttttagcaacggtttcgttgagactcaggatggtcagctgatgcgaaaagagttgagcaaggatgaggccgatgatgataagaggagcaatgatggccagcatcttccagtttacctgtaccaatcccccagcttgccagccaatcactgcagttgataaatcaaagtagatagtaatagcttgaccaatagcagaaaatagacttgctaccatggcgccagataaaattaaacgtagttgattgtagcctttttgcacctgataagctagaccaaagactaggccggctgccagacaggagcccagtaaacatattaataaaatttgactgtagtgcaaaccaccgaacagagcataggcaacaatgagagcaagtcctgctccagcattgattcctaataagccaggatcggcaatcggattgcgtgtaattccttgcatcattgccccagcttgggccatggcagctcctaccaagatggcggctaccattctaggcaagcgtaaatcgatgataacatcctgagcggaagaatttgtcagtggatgctttagggtttctatcagttgttggtggctataagaaatagctccaaagcgtaaactaagatagactccagctatgaaagaaagacagatgatgaaaaaaacaagccaaatattctttggctttgttttgggataacgagaacttactagtttgttcatatatccagtccttttactgaagtttttgaatttctgagacaaaggcgtcaatttgtaaatctaaagacatcggatcggagaagtagaagaggttatagtctatctcgatgacgtgaccattctttacagcaggtagatttttccaaatatcactttctttgagagaggcagctgcttcttttgttttatcattgacgttaacaaggacatagtcgccaacatattctggaagagcttcttgagataccccaaaccagccttctttattgatgatgtcttcttgaacctttgcaggagcggcaaaaccgagagcgcgatagattaattctccaccacgaccaaagttattaccataaaggaagatgttcttatcgaagaagtccatgacagtaaatgttgaacttgtatcaatcaatcctttcaattcctcttttgcagtagtaactttcttatcccattgatctaaccaggcttgtgcttccttttcttttccaaaaatctgaccaatatctgtcagcattttcaagtagtcactctttccataagtgatttcaataactggagcaatttctttcagtgtttctaagttatcatcaccagaaaatactagaatgacatctggcttttgtgcggcaatcgcttctgtatctgctgttgttaattgtggaacatcctttagtttgtctccaaagacgggactatttttctctaaatctagactatagctagatacatcaattcctaattgtaagagatagcctgtgtaagagtaagcaaagttgacaacttttttaggattttttggaatgtcaccgtggtaagtaatgccttcaatctttggcatgctagacagttctacgtctgttgaagaggaagaggtagagcaagctgttaagaaaaccagcccaacaaataaactaaaaatagctaaaaactttttcattttttctccttattatttttttaaatcgtaagttagcaaaatagggtaatcttgaccagcaacctgcatcaattgaggttcaatgctaaaaatgtccctaagtatctcagttgtcatcatattggacacagatccatggtagcgaatatctccctctttcatggcaatcatataatctgaaaatcgagctgataaattgacatcgtgaaggaccatcacaatggttttctgtcggctttgattcagttcttttaaaagttctaagacttccaattgatgattgagatcaagataggttgttggttcatctaagaaaatggtatccgtatcttgggcaagtgccatcgcaatccaaacccgttgcctctgaccacctgataaatcatcaactggtaacctagcgtagggagcggtccgggtgacttccaaggcccagttgattttctctctatcctgatcagtgagatgtcccagcccattttgatgcggaaagcgaccataggagaccagttcataaacggaaatcccttctgtcgcttctaagacctgagggagcagggccaatttttttgcaacttctttggttggcagttgtgaaatggcttgtccatctagatagatagccccttcttgaacaggaataatccttgtcaacgccttaagcaaggtcgattttccacagccattggcaccaatgattgtcgttatacttccttttggaatacttgttgataattcatcaataataatccgattgtcgtaagagacttggatattttccgcttgaatcgaagacacaaactcctcctttccagaatatgattcattaataatttgttccgaccagtattatatcaaaaaaatttaccaaaacaaagagttttctgaaaattttaatttaatgagaatcgttataaaaaagtccttgtttgtgaacaaggaccgtatgttacaaatattgttttgctacttccaaatcaccgtcataggcggccttttcgccgtttacaatctggtaggcatcggctcccttgcctgcgatgatgacggcatctttcggagagcttgtctgactcatggctgtgcgaatggcttcttcccggtccaagataaagttgcttgtacgggtcatgtgggcacggatttgttcagcaatagcagctgggtcttcacggttggggtcatcagctgtcagaatcacctcaatctgcggatagtcattgagcagaagaccgaagtctttgcggcgactttctcccttgttaccaggagctcccaaaatcaaaaataccttgcctgtctggtgctctaagacgacatcaatcagcttcttgacactatcgccgttatgggcgtagtccacgaataccttggcaccgttttgctgggtcaggacttccatacgaccagggacattggtttgggcaatccctgtgtgaatatcttccagacttgctcccaaacggagacaggccagtcctgctgcgatggcattttcttggttgaagccaccgatcagctggatgtcgtaatggccagccaatttgccagtcgctgtaaaatcaaaacctgctgactgactaatctggttttcagaagtcggcccataaaagtcatggtctttggagctgacttgctctttcacgacttcaaaatggtccattccagcattgacaatgaccgctctgctattgtccatcaaaaggcgcttgtgatagaaatagtcctcaaaggtcggatgctcaatggggccgatgtggtcggggctgatgttgaggaagacaccgacgtcaaaggtcagcccgtaaacccgcttgaccaagtaagcctggctggacacctccataatcaagtgggtcatgccgttcttgaccgcctccgccatcatggcaaagaggtccagactttcgggcgtggtcagggtggacttgaagaaggtcttaccgtccagcgtggtgttcatggtcgaaagcatggcaggtttcttgctctgtttaaggatgttaaaagcaaaataagccgccgttgttttacccttggtgccggtgaaggccaggagtttgagctgtttctggggatgaccatgaaattccatggcaatcaggctcatagcctgcttgatgtcgtggacgatgatagcaggaatgccgacctcatagttgatttcagacacgtaaaaagccagtccggcctcgatagctttttccagaaattcctttttaaaggccaaacccttggcaaaaaagagggtcattgggctaacagtccggctgtcatagctgagagcgtcaaactggacatccgtccatgtgctgtcagtttggtcattctgtttgatatggcggaagttagcatccgccttcaatatttctaatacacgttcaattgtaatcatgcttctattgtaaacctatcgaggatatttgacaagtctgggatatgtaaatagtgggtattttgaccgtaaatttgaatgaatatgacatttcgccctgaagcaaatttgtgctataataggagggattgaaaaaggagaagtttatgttttattcttatctacgaacactattaacattcttgttgtgggccatcaatggcaatattcactatcatgatagagagaagattttgccacaggaggaaaattatattcttatcgctccgcacaaaaccttctgggatccagtctttcttgggtacgcagctgctcccaagcagttcatctttatggctaaaaaagaactcttcaaagaccgcggttttggttggtggatttcaaaatgtggagcctttccaattgaccgtgacaatcctggcatggcagccatcaagtatccagttaacatgttgaaaaaaagtgaccgttcgctggtcatgtttccttctggaagtcgtcattcatctgagctaaaaggtggtgtggcggtcatcgccaagtcagccaaggtcaaactcatgccagctacctatgtgggtcccatgactatcaaggggctcttagctggtgagcgaatcgatgtggcttttggaaatcctatcgatgtttcggacatcaagcgtatggatgatgcaggtacagcagaagtaactagccgaattgaggctgagttcaaacgcttagatgaccatgcggcatctttccaaaccaagaaaaaaccaaatatcttgacttatatctatcgtatcccagttcttttgctggttgctcttatcttgggattgacctatgcctttagctatattgccagcttcttctggcaaccaagtactcagttggataaaaataagtaaatgaaactcgcagcttgcgggttttttgtattttttacgaactatataggtggaggtaatttatggatacgattaaaacttatatagaaatgcttaaagaatacaagtggcaaattgctctgccagcagtggctggcttgctaatggcgacgtttttaatattcagccaacctgctaagtctgatcaaacaggactgacagattttcctcaaaccgagcaagcttctagcagtcaggagcagacggaggaaaccagtacagaagagagtgaggagctcagccagctaaccgttgatgtcaaaggagcggtggaaaagcctgggttatatactttagaagctggtgcgcgtgtcaatgacgcagttgaagcagctggcggcttgaccagtcaggcagaccccaagtctatcaatctggctcagaagctcagcgatgaggcggtggtctatgtagccagcaaggacgaaaacatctcggtggtggccagcacgactgccagctctgctatgtctccagaagaaaaaagcaccagtctggtcaatctgaatacggcgactgaggcggacttgcagaccatttcgggtatcggtgccaagcgggcggcggacattatcgcctatcgtgaggcaaacggtggcttcaagtcggtgaacgacctcaacaatgtttcgggcattggcgacaagaccatggaaagcattcggccttatgtcacggttgagtaagctcccctgccagcccgttcacctggcagtcttggcggtggcagcttactttgcagtccactctttttccctcttgacaatgtgcctgctcagcttggtgttagctgtctttggtgttcggcaaggtaagacagttttcctcaaaacgctgccgcttctaaccctgtgtggtctctttttcggatgccaaaaggtccaatgggagcgggcagctcagtcagccccagagcaagtgacgactgtgcaggtcattccagataccatagacatcaatggcgacagcttgtcttttcgtggtcgggctgatggacaaaactatcaggttttctacaaattaaccagtcaggaggagcagacctattttcaaaatctggcagacctggtccagctagaagtggaagcagaggtcagcctgccagctggtcagcggaatttcaagggctttgactatcaggcctatctgaaaacacagggcatctatcggactgtcaagctaacggcgattaagaagattgtccctgtccagtcttggaatgtttttgactggctgtcaacttggcggaggcaggccttggtctatgtcaaaaccaattttccggctcccatgagtcactacatgacagggcttttgtttggggagctggatagtgattttgaccagatgagtgacctctattccagtctaggaatcattcatctctttgccctgtctggtatgcaggtgggctttttcatcgacaagtttcgttggattttgttgcgtctgggcttgaccaaggaaacagtggataagttacaaattcccttttcccttgtctatgctggtttgacaggcttttctgtgtcggtggtgcggtccttggtccaaaaaattctgggtaatctaggcttgcggaagttggataattttgcggtgacggtctttatctgtctgttgatactgccccgatttttactgacagcaggaggagtgctgacttttacttatgctttcttgctgacggtctttgattttgaggatttggggcaggtcaaaaaggctgcggtggagagcctcagtatttcactgggaattttgccggtgcttatgacctatttctatgcctttcagcctctatctatcctcttgacctttgtcttttcctttgtctttgatgtcctactcttgccaggtttgtcagtcatttttctcctgtcgccagttgtcaagatgacttgggtcaacggatttttcgtctttatggagaaaatcattgtctgggtggctgatttgggattgcggccttggatactgggcaagccgtctgagctggtcctcttgcttttgctggtcagcctcttcttgctctacgatttccacaggagaaagaaatggcttctaggactgagcttggtcctcgctctgctatttttcatcaccaaacacccgctggaaaatgaggtgacggtgctggacatcgggcagggggacagcatctttttgcgggatatgcgggggcggacggttctgattgatgtaggcggacgagtcgatttcgcggccaaggaagcgtggcaggagcggtctcggcaggcaaatgcagagcggactttgattccctatctgcatagtcggggtgtggataggattgatagtttagtcctgacccacaccgacacagaccatgtgggggatgtgctggaagtggcgaagcaggtccagattggtcggattgtcgtgtcgccgggaagtctgacggtgcctgactttgtagcgaccttgaaaaaaatcaatgttcctgtccatgtggtaaaagtgggcgaccgcctaccaatttttgactcctatctggaggtcctctatccagacgggacaggcgacggtggcaataatgactccattgtcctttacggtcgcttgttggaaactaactttctctttacaggagacctggagcaaggggagttggacttgatagaaacctatcccaacctgcctgtcgatgtcctcaaagccggtcaccatggctccaaaggctcttcttatcctgaatttttagaccatatcggtgccaagattgccttggtatctgctggagaaaacaaccgctacaagcatcctcaccaagaaaccttggaacgatttgacagccggaatatccaagtctatcgcacagaccagcaaggagccattcgcttccgaggttggaaggagtggaagattgagacggtgaggaggtaaaatgataaatcctatgcacttatggttctatagtttcaaagtttatgtgctcgctgccttatctggctatattctgcactatgttactacgccagcttctgttaacgacttcaaagaggttgctgccttattggaaagatgctaacaatctgtgattgtagcagatttgggctatctcagtcagcagtcttgctcattccattgtatttcaaatagtctatattttgaatttaagaattgattttcatttcttttcattaaatattgaaatcgttttcgaatttgtggtataataaagtatgatttaccaaaggaggaagtcctatgtctgttaaagattttatgacccgtaaagttgtttatatttcaccagatacaaccgttgcacacgctgcagatattatgcgtgaacaggatttgcaccgtctacctgttattgaaaatgataagttggttggtttggtcactgagggaacgatcgcagaagctagtccatcgaaggcaactagcctatctatttacgagatgaactaccttttgaataagactaaggtcaaggatgtgatgattaagaatgttatcacagtctcaggttatgctagtcttgaagatgctgcttatctcatgtataaaaacaaagtggggattcttccagttgttgacaacggtcaactatatggggtcattactgatcgtgatatttttgcagcttttcttcatgtctcaggttatggagaagaaggagtacgcgctcggttccttgttgaaaataaggcaggggagttagaaaaaattattcgattggtggcagataaggattataatattgtatctactgtgcaacttgctaccaagtccggaaaagttgtcatcgaagtgcagattgacggaaaagttgatgttgaagaagttcgaactcttttcgaaggtgcaggtatccaagtggatagcttggttccgactgttgctaaaaatatttaaaaaccgagatttctcggtttttttctttagctatcattctagtattttaggggaatgtgatataataaagtatatcatgtgtgaggaggctctatggggcacaaatataaaaagtataagaaatatggtaaaaataattcaggacttgtggccctccttgttttattggcaatcggttttgtcatgagtttctggtatatcttattgcccactgggctcttaattggctatttttacaagagagaggctatccagcgttttttgaatagagattctataaaacgcttgcaagtattagcgctatctattcgttcgggctatgaaaagcatcaagagctcttggtggaaaagggtgaggataaggttgtattacagttgagaaacagactgttaggacaattatttgaattagatcagctctatcaaaaatttggaaaatatctgaatggatatgaaagtaaagaagttgtagataccttgcaactaaaatatcatttaaaactgccagaagctaaaacagaaaaaaatactgacacacaggtttctactggtggtaatgctgtgatggatgaacaaggcatgatagcggatttagctcctgaaattctagaaacctattgtaatattcaaagagacaatcttgttattcttgaaaagctggaaaaggcgacagataagcgggaagaattgacagctatccatgaggccaatatgaatcggtttaacgatattttacagggttatttgaaaatcaaaaaatcaccgaaagattattttaacgcagaagaacgattggtgcaggcaaaatcagccatggaaatgtttgataaggatttggatgataccatcaaacaatttaacgaagcggatatgaaagattttgaagtcagtctgcgtatgatgaaaagagaagaggaatagagaagatgtcaggatttaatttcgatattgatcagattgctaataatagtttatcaaccaaagataagacaacagagcttattcaagcgactccgactggagataattcaaaagtgtctttcttggcacagttgacaccggaacaacaaacaggtattcgtgccaaggctccccaattggtggataatttcttagctaatcaaaatgtcctcttggattttggtaaggaagcggtagaagaagtcaatgccacggtcaatcacattttgtcagaacagaagaagattgaaattccacaggtcgatgagcttttggccaataccaaccgtgaattgaatggttttgtggctaagtataaggacatttccacaactgctgaattagaaaagaaacctggtttcttccaacacctgttcaagcagaccaaaaatgatttgcaggaattttatttcgattcgcagaccattgaaaagaaaatggatagcatggcagccagtgtggtcaagcaggaagaggtgttggcgcgcaatattgtttctgcagagcttttgattgaaaataataccaagtctatcgagaatttggtgggggtcatcgcctttattgaagcgactggtcaagaggctgcccagcgagcaaaagcagagcaagaacgcttggcaggtctgcaaccaactacggtagattatcaagtagcttctgagaagttggcacgtgtaacagaggttgctaatatcctcgaacaacaacattctgagtatatgagtcgcttgtatgtcgcgtggacaacgacaccgcagatgcgtaatctggtcaaggtttcttcggatatgaaacagcgccttgggatgttacgtcgcaatactattccaacaatgaaattgtccattgcacagttgggcatcttacaacaatctatcaagtctagccagacggcagatgcgattgtcaatgctaataatgctgcccttcaaatgcttgcggatacatcaaaagaagccatcccgatgatggaacgcacagctcagaatccgaccctttcagtagcatctgttaccaaattggcagaaagtttggttgcccaaaataatggcattattgcagctatagatgaagggcgtcagaaacgtcgtgagttggaggcagctattgtacggtcagcagagactatcaacgattctgttaagctacgcgatcaaaaaatcattgctgctttgctggagcaaggcaaagaagcacagtctgaggcagagcaaccacttgaaaccaatcaataatataaaacctgcagttcagcgaaactgcaggtttgtttaatggcgttctattggttttttatctcgatctaaagtaaatccctcaccgagtacttcatgtgcgtctgtaatggtgataaatgcgtgggggtcaatacgatgaataagctccttcatctcttggagttggctcttatatatgaccgagtaaatcatgttgacatcggctttgctgtagaaaccttgtgctttgataaaggtgacaccacgctcgatttcacaatcaatagcctgagccaattggtcagatttttgagaaacaatcataacacccttgctaccatatccgccctccgtgacaaaatcaataaccttggaagcaatagcaaccatcattaaagtatagagaactgttcggaggtctttaaaaacaataacaatcagagttaggatgaggatgtcaactgcaagaatgatttgtccaatggagtaaggtaggaatttatgacctatacgagcaataatatcgcttcccccagtcgttccgccagcacggaagatggttcctaatcctagtcccataagaatcccacccaggatactaacgagtatcaaatcttgttgtagattgattgaaaaatggattttttcaaaaatggccaaccaaaaggtaacgctaaaggttcctaagatactgagatagagagtcttctttccgagtattttccacccgaggatgaacaatggaatattaatcacaatgttcattatccaaggttgaatatgaaaaaggtagtaaataatcagcgtcaatccagttgcgccaccctcgaatagacgattgggcatgattaaataatttagcccaaaggcaaatagccctgcaccaagcaaaataagtaaaatatttttcaaacgaaccataagcatctccgaatatgtgtatatatcaattttaaaagattttctccttaaaaacaagtcaattttcaagtgattttttgactaatttttggtaaaatggaatgaatatctaagaaccagtcttcacaagtgaagtgctgaactgtgcatactggtactaagagcgagggaaagatgagaaacggtttttttattacatttgaaggtccggatggggcagggaaaacaacggtattgcaacagttattgccagccttgcaggaattggggccagaagtagtcacaactagagagccaggtggggtggctattgcagaagaaattcgtaatattattctgaatcctgcaaatacagcgatggatgataagacggagctgttattgtttattgcagcacgacgtcagcatttgaaagagaagattcttccacccttggcacaggggaagttgctcttgattgatcgttttatcgattcctctattgcctatcaaggatttggacgggggttggatataggtgacattcattggctcaaccagtttgcaacagatggtttaaagccagatttaactctctattttgatattgatacagaagaggggctggctcgaattgcccgcaatgctgaccgtgatgtggatcgcttggatatggaaaaagcagatatgcatagacgggtgcgtcaaggctatcttagtattttagagcaggaaccagagcggtttgtaaagattgatgccagccagccactagaggctgttgttgcaaatgctctggcggtcattaagaaacggtttgcagaaagaacatgaagattgaagaacttagaaacttacaaccctatgtatttcaacgttttgtgacaattttagagcagagacgtttggcacatgcctatttattttcaggtgactttgctagttttgatatagcaatttttctcagtcaatcgttattttgtcaggagaaagaaggcatccttccttgtcagaagtgtcggtcttgtcgtctaattgaagcaaatgagttttcagatcttactgttattgcaccgcagggaaatgttatcaaaacagatacgatacgtgaattagttaagaatttttcacaatctggatttgaatccaataagcaggttttcattattcgtgatgctgagaaaatgcatgctaacgcagccaactctttgctaaaagtgattgaagaacctcagtcagccattcacatcttcttattgaccaatcaggaagaagctgtccttcctactatcaagagtcggacacagattataggttttcctaaaaatattccagctatggagcgaatgttagaagaggagggcttgttaaaaacacaagcgaatctcttagctcaactggtttcaagtcaagaagaagcgaaaaagttagcagaaaataaaaactttttagatttgatgggacaggcaaagaaatttacagacttgctcttggtggagcctacacgtgcttatttgcaagttggaatcctagtgtctttagctgtggaaaaagctgagcagggacgtttgtttgaccttctgagtctgatattatctgagaaaatgatggaatcggcaaacgtacgtgaaaaaatggatgctgttcttaaggctaagaagatgtggcaggcaaacgtaagtctacaaaatagtctagagtatataactctgtaaaataaaagaaagggagataatggataaaaaagaaatttttgatgccctagatgatttttcgcagaatcttctaaccacgttggcagaagtggatgctatcaaaaagcatttacagggagttattgatgaaaatacgaccctccgcttggaaaattccaagttgcgcgaacgtttggaaaaagaagataagacaggccataaatcttccaactttggtaaggagaatttggagaatatttacgaagatggtttccatatttgtaccttctcttatggtcaacgtagggataatgatgaaccttgtatgttctgtgtagaattattgaatcgagattaggatgaaagtacaaaaatcatttaagggacagacgagttttgggactttatatctggtgccaacgcctattggaaacttacaggatatgacatttcgagctgttcagattttgaaagaagtggatataattgcagcggaagatacgagaaatacaggcctcctactcaaacattttgaagtagaaaccaagcaaatatcctttcatgaacacaatgcccatgaaaaaattccagttttgattgattggctcaaatctggtcagtccattgcgcaagtttctgatgcaggcctgccttccatttcggatcctggtcatgacctggtaggggcagcgattgcggaggatattcctgttgtagcacttccaggagcatcggcgggaattacagccttgattgcatctggtttggcaccccagccacatattttttatggatttttaccgagaaaatcggggcagcaaaaagaattttttcaagaaaaaaagacctatcctgagacgcaaattttctatgaatctccatatcgtgtggcagataccttagaaaatatgttgacagtttatggtgatcgtcaggtaacggttgttcgagaattgaccaagttatacgaagaataccagagagggagcatttccgaattactagagtatttggaagaaaatccacttaagggagaatgcttgattattgtcgagggtgctggtgaagaagtctatccttctgctgatgaagtggacttgaaggctgaggtagaaagggaaattgcaagtggcataaaacctaatcaggctatcaaagaagtggccaaacgctaccaactcaaaaaacaagaagtatacgatatatatcatggactaggttaagacctagtttttttgtatgtttatgcaagcttatactcttcggaaatcaaaattatccgttgtcaagagccttgatgagtgaaaagctccagtggatcttttcagcctgttaccttgaaatgagaaagtaacagagttctatcttcggcttaatgacgcgaacacagttctctatacttccagccttcaactatatcccagctaagctacttttgattttcattgagtattaatatgcagatagcaattggtgacactccccaaacagtcaaatctggtcataaaattttcattgaaacctgataaatccctgtgaggcaagcgcctcgtttatggctaaaagtaagaggtgctttagaaagtagaataaatataagaaatccgaatatttttacaaaataatcatatttcatggaattgtctgaatatttgtgatataatgaacagactaacttaatggagggattttatgacaatctacaacttctctgcaggtcctgcagtattgccaaaaccagtacttgaacgcgcccaagctgaattcttggactacaatggttcgggaatgagcgttttggagatgtcgcatcgctccaaggacttcgatgatattattaaaggtgctgaggcaacgcttcgtgaattgatggccattccagataattacaaggttattttcttgcaaggtggagcttctttggaattcacaatgattccccttaacttcgctcaaggcaagaaagcctactatcttgtaggtggctcatggggtaaaaaagcctatactgaggctgtgaagctgtctaaaacaattgcctttgaaccaattttgcttggatcaacggaagatattacctatgcagaattgccaaccttcgataaaaatgatattgatccaactgctgcttacgtgcatttgacaacaaataacactattgaaggaacagcagtttatgatattcctgacaccaatggtgtgccagtcattgctgatatgtcttcaaacatcttagcggctcgctataatgttgaagattttgccatgatttatgctggtgctcagaaaaatattggtcctgctggtgtgacggtggtgattgttcgtgaggacttcctcaatgatcaaccaatgctttcaagcatgttggactaccgtattcaagcagaaaatgactctctttataatacgccaccagcttattctatctatatttctaaactcgtctttgaatgggtaaaagaaattggtggtgttgatgagatggagaaaatcaaccgtgaaaaatctgggttgctttatgactatatcgaccagtctaatttctatacaaaccctgttcgtaaaaaagaagagcgttcagtagcgaacattccttttgtctcaccaagtgaagaattagatgctaaatttgtcaaagaagcaacagcagctggttttaaaaacatcaaaggtcaccgttcagtaggtgggatgcgggcgtcgctctataatgctttcccacgtcaaggtgtggttgaattgattgaattcatgaaaaaatttgcagtggagaatgcttaatggaaattagattagcacatccaaatgagatggaggctattgtcaatattcttgaagatgctcgtgcatttctagcaacctccggtatcaatcaatggcagggagagtatcctaataaagagaatatttttgatgacattctttctggcagaggttacgttggtctagttgacggtaaggtggcagcttatgccgccgttcatcgtggtcaagaagcagaatatgaggccatatatgaaggaaaatggcagcacaatcatcctgtatatacaacatttcatagaattgcagcagctgacgaatttcgtggtcaaggaatcatacaaacttttttgcaaggtttaattgaaggtcaaaaaggaccggatttccgctgtgatacccacgagcagaataagacaatacagcacattctaaaaaaattgggctatgtctattgtggtaaagtcccaatagatggagaacgtctagcctatcaaaaaatcaagcaaaagagcgagcggagtctttaccaggaaatcagtgaagacgaccgttggttactcggaaataattaatgaaataaagaaagaaaaggcggcagctattccgcctttttaggtaaaaataaatggtatttagcgtacgtacttttaacaatatcaatcaaattggtcttaaggaattaggcaataaattccagattgacggagatcatgcagcaaatccagatgcctttattattcgatctgaaaatttgcatggatttgattttcctgaaaatctaaaagctattgcccgtgctggtgcagggactaacaatattccaatcgaagaggcaacagagaaaggtattgttgtctttaacactccaggtgccaatgccaatgccgtaaaagaggcagtcattgcttccatcctcttgtcagcacgtgactatatcggagcgactgcatgggcaaatacattgtcaggagatgatgtacctaagcaggttgaagcaggtaaaaagcagtttgctgggacagaaatttcaggtaagactcttggtgttatcggacttggtgctatcggtgcgcgtattgccaacgatgcccgccgtttgggaatgaatgttctcggttacgacccttatgtatcagtagaaactgcatggaccatttcaagccatgtcaaacgcgtggatgacttgaaagaaatctttaccaatgcggactacattactgttcatgttcctttgacagataagacacgaggacttttcaatgcggatagcttttgtcaaatgagaaaaggaacaaccttgataaactttgcacgcggtgaattggttaataatgctgatttgtttgaagcaattgaggcaggagttatcaagaactatatcacggattttgggacagaagaagtgctcaacaaggacaacattatcgtcttcccgcacgttggtgggtcaacagaggaagcagagctcaactgtgccattgctgcaggtcagaccattcgtcgttttatggagacgggtgaaattatcaactcagttaacttcccaaatgtgaaacaattcctagatgcaccgtatcgtattaccttgattaataagaatattcctaatatggtggcaacgatcacaacggctgtatctgagttgggaatcaatatcgataatatcatcaataagtctaaaggtgactatgcctatactttacttgatttggatgaagcggataaagtgaaaattgagcagttggttgctaaatttgaagcaacggatgcaattgtcaaagtgcgtgtcattcagaataaaaactaatcatgctgtataaacaagtctatcacagtccacttggccccatgtcattaattgctagtgataagggattaagaggggcctggtttgagggacaaaaatattttgaacgaggcttgaatgagaaagctattttagcctcccatcccattttagaccagacagctcgattgcttgaccagtatttttcaggggatcaggtggacttttcaaaccttccattagaagctgtgggaacaaatttccaagagcatgtctggcaattattgaagattattccgatgggtcagacgactacctatggacaactggctcagcaactgggccttcgttctggtcaggcagtaggaggagcagttgggcgtaatccttattctattattgttccttgtcaccgagttctcaatcagaaaggacagttgacaggttatgcaggtggactggataagaaaatctggctcttgcgacatgagaatccagaatttgaggtgaaagatgattttattttatgagtatccaaaatgttcgacttgccgagcagcaaaggcggagctgaagagtttgggattggaatttgaagctattgacattaagtcaacaccgcctagtgctgaagagctaaaagcttggatggaggcgacgggactagaattgaaaaagtattttaatacttctgggaatagctatcgtgaattaggcttgaaagataagtttgatagtcttagcttggagcaggcacttaatcttctagctaatgatggtatgctgattaagcgtcccctactgattcaggatggtaaaatcttacagattggctatcgaacaaaatacgaaaatctcggtttataagccgagattttgtttattatagtgcatattctattgaaatatattcatgatgttttttcaaaagatagagcatctgaggcttatcttctaagagtttttggataatttcgtgatggacattgtggagattgattttaacgcgaatcttcatgccttgtttgaaaatatggatttcgacatcattgctatcttcctttaagtaaggctccaatagctgatagatagaatcatgtatctcagggaaatggatcgttccgttggcgagttccttgaaagatgccactaataagttccaaggttccttaaatgaaatgattgctagtgctagtgtcaaaaagaagtcgccagtataatgcaggaagccgaaccaagagttgataggaacaagatagagcagaagaattgcaattccaattgcacctgaaatgagtccgtctacaaggttgccttttgcttctgctaatatgatagtagacagatgattgactttggcactcatatggcggttgtataggtaaagccccatacagacaaaaaacatggttatggtataagggagaacgggacctgtagtcatttgatgaccgattccatgaacaaagtaagcaaaggctgtcgcgcttgtttcaagtacagcaaatacaaggagtagtagagttgcgagagatttcatgatagcgtagagaggttctagaaagtatagtccttgaggaaaagtctcggttttccgatggctatttttcgatatgtaaactgcaactaaggacgaaataaatgctattagagaaaagactccgtctaggaggagggcgtttaggtcagtcatgatataaacggcaatacctgctagtccagataaaccgttcacaacagaggaaacagttagagatttgcgttcgataattttgtggtccataatccctccttttaatatatatctatatatttattttaccacaaaatgacaccgttttcaaattgagcggattaaaacaaggtagagtgataagaaataaaggctcaaaacccttgcaatagatctacgggttttaagcctttaatatctgttatctgataattgaaatcaggttaatttccactgttagaatgaaatctccatcacaattggtgtatggtcctgacgagcaccggagtcaatcatatctgacttacttactttgtcggcgatgcggtcgctgacaagccagtaatcaattctccagcctgtattgttgattttactggtgcggctacgttgtgcccaccaagtataggcgttgagaacatcaccgtgcaagtggcggaaggtatcagtaaaacctttagctagaagatttgtaaaaccttgacgttcttcatctgtaaatcctggagattgacggttacttgcgggattagcaaggtcaatttccttgtgagcaacgttgtagtcacctgttgcaagaacaggtttgtggctatcaagttttgctaagtagtcagcatactgtacatcccagatttgacggtcagcaagccgtttcaagccatcaccagcatttggcgtataaacttgtgtgacatagaagtcatcaaattctagcgtgatgatacgcccttcagaatccatggttgttggagcaccaatctcaggaaaggttatggttggagttagatggtttttgtagaggaagagtgtaccagcatagcctttgcgagctggttctacagatgaacgccaggtattggcatatccagggaagtagctttccaaaatttctagatgctttttagtcggtcccttatctgacaattttgtctcttgaatggcgataatatcagcgtcttctgtcacaagtgtatcgatgactgcgcgtgataatagggcgcgaggagactctgcagtcaatgcagcgttaagagaatcaatgttccaagaaatgagtttcataattttccttttctagtctgttactgttttacattataccaaaaataaaagttgcaggcgaatatggaaacttgaaaaaaattttataattcttgtattataacattaaaattgtgatacaatagaactaataaatctgtgtcaaggaggttattatgaaaagaaaattatttgtttttgcctggttagccctagttttggaaatgctaatctactactggtaccagttgcctgctttaaatattttgagtgtggacttctggatatttttccttcaatctgtcggattggtctggctcatactttccacgttcagctccaaaggtgcttttcaaaaggtgaccaagatttccggtcgccagagacaagtagatacctatcagattaaaacctcgcaactaccagcttacttaaaatggttgggacgaatttgggtattggttgtcctgggtttgttggggttggggcttatcaactcacgtgtatttcgtgctaaggattacgctgctgtcataagcgtcaaggatgcggattttaaagcagattttcctgaaacagacatatccaaattggccctcctagatcgcgcctcagccgaaaaaatcggtgatacttatctaggtaccattgacaaggtctcccagtttggcatttcggatgattatcgccagattactatcggtcagcaaccgttccgtgtatcgcctttggaatataagaatttttggaaatggctgagcaaccatcaagatgggattggttactacgtgaaggttaatcagacaacagggaaggcagaacttgccaagttgagcaaagccatgcactattcagattccgaatttttgctgaatgataccttacgtcatcttcgcctgcaatacccgacaactatttttgggaaaccatccttcgaagtggatgaccaaggaaatccatattatattgcaacgatttacgagccaaaatttggactttcatcaaatgatccgattggtgctattgtattggatgcagtaacaggcgaaagtaagaagtatggtctggaagatattccagagtgggtagaccgtgtttattcggcaaacaatgttatcagccgtgtagatgaccactatacttatcaaaatggtttctggaataccattttcagtcaaactggtgtgaaaaatacaacagacagctataattatatttctatcggctcagatatttatctctacacaggtatcacctcagcaactgctgattcatccaaccttggatttattcttgtcaatatgagaactcgtgaaattaccaactacaaattggcttcggcgactgaaacagcagcgcagaagtctgcagaaggtgaagtgcaggaaaaaggctataaagccactaatccaagcctagttaagttggcagatacagcctactatttagtatccttgaaagatgatgccggcttggttaaatcatacgctcttgttgatgccgaagattatcaacaggttactgttaacaacgatattgcgctcttaatttctcaagtcacaggaacggatgcttctagcctttcaggattgacggtgactgaaaatggagaagttggtgaacagactgaggttatcagtggaaaagtagaagctttagcgagtcaaataattggcggtgcgacaatctactatattgagtctgagggcaagatttacaaagtcaaagcaacggaagatagtacagatcgattaccatttatcaaagtaggagatcactttagcggtcagttagataagaaaaattatcttaaaaactttaaggttaatccagaataatcataagaaagagtgaggtagaaaagccttgctcttttgcttgtcgtcacccatgcgaaatatttcaacttatggtataatggagtgttgtggttctttgacaggaatccgtagattattctgtcgagtatccatattcttattctgaaggagtattttgtgagtttatttagaaaaaaacaagcagtcggtcgccatagtcaaatgcgtcggcatttaggcttagttgatttgatatttttaggtatcggttcgatggttggaacaggtatctttacggtaactggtttggcagcagcccagtatgcagggccagctctgatcatctcaattgttattgcagcaatttcagtcggactaacagccttgttttacgcagaatttgcctcgcgtataccgactaacggtggtgcctatggttatctctactcggtttttggtgaatttcctgcctggattgctggctggctgacaatcatggaattcttgactgctgtatcgagtgttgcatctggttggggagcttatttgaaaggactcctggctaattttggtatcgctatgccgacagctctgaatggaacttttaaccccgctgcaggtacctatgtagacctcttaccagttctcgtcttgatttttgtggtaggagtggtcttgcttaattctaaggcagctcttcgtttcaattcagccttggtagttttgaaattttcagcgttggctttatttattttagtagggttattctttatcaaaccagaaaactggtcgaacttctctccttttggttttggtgccatttatggtggacaagcaggaattatggcaggagcgtctctcatgttctttgccttcctgggatttgagtctatttcattagcaattgatgaggtgaaaaaacctgagaagaatgtaccaaagggaatcgtgttgtctctatccattgtaacaattctttatattgtagtgacattagtattgactggtatggttcactatactaagttgaatgtggcagatgcggtagcttttgcacttcgagaagttggattggattgggcagcgagttatatttctattgtagcaatactaacattgattacagtatgtatttcgatgacctacgccttgtcgagaatggtctattccatcagtcgtgatggtttgctaccgaaatcattgagccgattgacacaaacaagcaaggttcctaagaatgcgaccattcttgtggggatttttgcagccatttgtgcaggtatttttccactagcaagtattgcttccttcctcaatatctgtaccttagcttatttgatcatgctggcgttgggtattattcgtctgcgtcaagtcgaaggtttgccaaaagatggacaatttaaaacacctcttgttcccttgttacctatcctctcgattatcatttgtctttcatttatgttccagtatagtttagatacttggttagcattcggagtatccttggttattggaattttgatttacttctgttatggctatcgtcattcggaagcaaaataatagatttcccttcttttatttgaagggattttttgtacaatttttttatagaaataatggaaaacttaaaaataaaatagtataatatatataaatgatacaaatatatcaaaggagaaaagcaatgtctaatagcgatattcgagctaaagcaacggttattcgtgaacaaacagataggatgataaccttgtttttggcacctgttttgatttcttttctgtcaggagtggcagaatttggcttgaaacaaatctgggggcaaactggtactttctcctggggcacaactattgtgaaagacggtgttacttggactcatcattttatttctgttggcccgtcaatcatatttgattttattgcacaatgtttaattgtaacagcttgttttcaactaataagactggtgagaaagcaaagaaccaaggttagctttacggagtgtttcactttactagatggggagaattttttaccagtttttagtacgacattattgaaaatgctggtcttgtatttagcaagtttccctgctgtttttggaatgatattgataggtttagctttctatagtactattgtcatctttggtgctcctattgattatcagcctgatttttcagcttttttcagttcgtcttattttcaaacaggattaatactggtatgtgtagggattatttgtagtttattcgtaggatatgggctcagtcaggtcacttttcttctctatgattatttggaaaacaatacctattcttcaccatttaaactcttcagttagagctggcagttgatgaaggggaataaatggcgccgtttcctcttggatttatcttttgttggctggtttattggagttcttttgacgtttgggtttttgggactttacgtatatccatactattggacttgtcagactatattttatgaagatttgaaggccaagaatccattggtgttttcaacatataaatcagttatctcttccatagtagcctagggagtatggagataacaaattattaggaatcccttcgtattttggagggattttcctgtttttaagagatgttctggaaaattaatggataaagttttatactaatagtaggatggtaaagtagtccgatgtagatataatatttgcgacgtgactttataaataaggagagaaaattggaggggaattgtgatgatgacgagtgatatagtatcaagagcgatgatgactcgcgagcggacaagaggtacaacactactattttttccctccattttgctatctattgtttatgctataccagcaacaatttttcgcctactaacatttctagagctccgtcaaaacagtgcttttgtggaggggcgattggtatcttcaatcaggttgacctatttaggtgagttaggcttcgctctgttgttacagctgttcatcggtctgtcctgttttcatttattggaattgttgagaggggatagacaggagttttctttaaaagatagtttttcatttttaaagacagaatggaagaagcctatctgtaccacttttctttattattatttgcttctttttatagctggacttccagctaatctaggggctactttatttattaaaggcttcacaatgagtagtttgatggtcttatctccgggggcaatggcagagctggcagttcatcagcctagtcaattaatgaagataggggctccgattttcctgctaggaatgattatttacctttttgtctactatacctactcacaggttgttttcgtcttgtatgaccatttggataatgctagttatactggtcccctggctgtatttagggaaagtcgtttcttgatgaaagggaactattggcaacgtatttggttagatttatcctttttaggttggtttattggggaattattgacccttcatctgttatctttttttgtgactccttactatcatttatccaggactattttctacgaaaaattgaaaaaacaaagactgtcagctgtagagtagctaacagtcttttatgattatagggagcttgttttgggcttgaaatagagatcgtaaaccaaccagcaaatcattataccttggacaagcaagctgatgacggagccctctacgccaaactttccaccagatagccactcaggaccagtgataccgatttgaataaaggcctgaccagcatcggtgccgctgactgagaaagcaaaaacattcccttggaaacagttccacgcagcgtgtaagccaccaatcacccaaatgttgcctgttttgagcataatgaggcaggcaagaacggcaaatagagttaaatccaaaattggaatgagtgaaatagcattgtttccgaggtggagaaatgtgaagaagagggaagaaacaatgataccgataggaatattatgtctagcagaaagtgatgagaacatccatcctcttgttagaatttcttctgtcgtaccttggatagaccaggcaaggataaggataataaattctccgactaattttgtagagaactggatgcttgtaaattcaatcgcgcctaatccccacatgatgagtgtacaagtggtcagcattgcagctccgattccccacccgagtagaaaatcttttcctgcaccttttttagtaaaaccaagtcctacccacgggcttttttcaatataccgtgcccataaaatgaccatcaggctgataaaagcgaaagcgaacagttcaaaacttacagaaagggtctcgctaaatgggagtaaaaagcttattggagtgaaaataacagctcctagtgaatctcctactagcaacaaaataatagctacaataggagaggtgacgatgttgagattgaaagctgattgagccttctcattgataaattcggttttcataggacctccttttactagatactttactagttcactattctatcatatttttcaaaagaagactagacctaatttcctagtatatggtagaatagtacaaagctatataaggagaatagtatatggaattgagtcaatggctgaagtcctttcaactgaaagataatcgactagtgggcccattcttttatggcacacctcttgctcttagatttgaaatcgggcctgcagacgaagcagaagaattatcaagagcaatctatcttgaaagagcctatgcacgtgcagtagaactttttgagcaggctagttcagaatacgactatgtgctcctttcgctccttcgacaggaagatagggatatagacacctacctctggcatttttcatcgaaatttaacttcaacaaggtccctgagtctgagttgatagaagtggaggattggacgggagatgtgctagtctttgagcgctatctctttccagttaccgaccaggacctaaacgctttgttgagggagattgtcaaagccgaccatggaggttttaactatctatcaagttccgttctcttcctatctagtcaggacaatatcatctatcattgctacgataatcggggagttgatattgctgttttagctgatgacaaacgtttggagctctttacagactgccatgacctccttttggactatgatatggaggagatggagagaagggtgagggggtaggaaaccattactaaaggtgatataccatctcttagataaaagtacttcacaagtgaatacaggttcaaaaaaatccacagtaaaacctgtggaaaatatggtagaatagaacagtagaaaagttccaaaagtggagcggaaatctattttgggaggtggcaacttcatttttgatggaaagtaaaactttctcatcaaaaaacgaggctgggcaaaaagtccaaagccacttctcagagttcgtgtcaacatctcagcgcagtggttgtttgggtttaacagtccagtggactgttaaaggttggagataggatttgcaaagcaaatcacagcagttcgtgtttcacactccaaatctgaccattacgactgatgcgaacagagttcgcttcatctccaacctcaaactgtctcccagacagtttgagctgtgcggggggtgggagtgaaacagtctgggaatagactgtttcagctcaacaacttaaaacgaaaaattgttgacgaactctttttgacaagttgagttctttcccactccctaaaagttgcactaattcgatttttgaaaaatattgtttcaaaaatctcatgtcgatgccagagacaatcagcatctctattgattttactctaactaatgtctgtcgcagaagccttcgggctgatgtttcagtttagcacgttgctaatcgtgctactgacatttatttttaacaatcgtaaaaaataaaagacagccaaccgctacgaaactttgaccgagtgaactagcaggttgactgtaatcttcatttgtcccgtctttaaaatgttcaaacagtctgggagactgtttgaggtcgtttctcgaaaacggaagaaaacgatactgggattgagttggcgctcaatcccttttccaaaactattataccacaaaccaaaatcgtttgacaattttttatctacatcatcaaaaacggcttgacagcctaagaaaaggagaataccatgagcagagcagagcagagcagagcagagcagagcagagcagagcagagcagagcagagcagagcagagcagagcagagcagagcagagcagagcagagcagagcagagcagagcagagcagagcagagcagagcagagcagagcagagcagagcagagcagagcagaagcttggagactacactcaagttgaaaagctagacctaaggtcaaaagatgttttatcagacaacattgcaaaaattggtcagctttttcctgaggttctaacagaaagtagtgatgaaaatggcaggtaaaccgaccaccaagacccttcgcccagatcttgaggaaagtgttgactttgacaagtctgaaaatgtctttataacaggggacaacctggaagtcctcaaggtcttgcaggagtcttatctgggcaagattgatatgatttacattgacccaccttacaatacaggaaaggactttgtctattcggataaattccagatgagcgaggaagaactggcagatgaaatggatctgcgtgatgaggacggtttgcaacgggtgggcttgaccaagaatgaaaaatcctccgcccgctatcattccgactggctcaatatgatgtactctcgcctagtccttgcccgcaacctcctcaaagatagtggagttatctttaatctccattgacgataacgaacaagccaacctcaaagctatctgtgatgagatatttggggaggagaattttgttgctgatgtcatctgggagagagcatttgcacctgtaaacttgaaaaaacatttttcagaaagtcatgattatattttagtatatgcaaaaaatgtagaatttgctgtcaatcatggaatacctagaagcgaagactcaaatagtagataccaaaatcctgataatgatgttagaggaccttggacaagtggtgatttatcagtaggaccagcagttccttcaaatatttatgagataatttctccaagcggaagatctatttttcctccaagcgggagaagttggttgctgagtaaagaaagatttgaagaatttattgctgataatcgtatttggttcggggctaatggagataatgtgcctaggataaaaagatttttatcagaagtaaaaaatacagtaactccaatgacgatttggaagtacgctgatgtcggtcattctcagtctgctagccaagacttgaaaaaattatttgatggtaaggcatatttcacctatccaaaaccagttccgttgatgaagcaaattgttcaattgtattcagaaaaagacggcctgatcctcgacttcttcgctggttctgcaaccactgctgatgctgttatgcagttgaatgcagaagatggcggtaatcgtaagtacatactctgtacgctggacgagcaggtggcagacaagtccgctgccaaggaggctggctatgaaaccattgaccagatttctcgtgagcggatccgtcgggctgctaaaaagattcaagaagaacacccagaaacagtcggcaagcaagattttggcttcagggcttataagctagacacttcaaacttcaaggatgttagccaaacaccaaacagctttagccaagaaagcctatttgacagtgtttccaacatcaaagacggtcggacagaccttgacctgctcttccagattatgctgacatggggcatggaattatctcttccgattacgaaaacccagattgacggtacagccatttataatgtagcagatggtgccttgattgcctgctttgcggatgagatttcagaaagcgtcctctgtcaaatcgccaaagcagagccccttcgtgctgtttttaaggacgaatcctttgccaactccgcagccaaaatcaacctgggccaaatcttcaaagaagaagcaccaaataccaaagtgaaggtggtgtaggagatgaaacttcaatttaagcagcagcaatttcagttagatgcggtggcctctgttgtggatgtttttgttggtcagggcaaacatagcggttttgattaccacatggataaaggtcagggaatgggtgcggaactggacatgaattttatcggtttccgcaatgctcccattcagctttcgcaggaaactgtcagccagcaggttcgagctaagcagctcagctatggccttaaaccatctgaaaacttgtctattcaaaaagtggatggtcgtccgtcttacaatttgactattgagatggagacggggacagggaagacctacacctatatccgtaccttgatggagctcaataagcagtatggttggctcaagtttatcatcgtggtgccgagcattgctattcgtgagggagtgctcaagtcctttgaaatcatggcggaccatttccagatggagtatggcaagaagccacgctattttgtctatgattctagccgtttgggcgagctggacaagtttgccaactcctcggacattcaggttatgattatcaactcacaagcctttaatgccactggagcagatgcccgtcgtattcacaccgagcaggaaagtttccgctggagaaagccgattgatgtcattgcggcgaccaatcctattttgattatcgatgagcctcagtcggttgaggggaaaaagactaaagaacgcttggaggacttcaagcccctatttactctccgctattcagccactcataaggacaagcacgatatgatttatcgtctggatgccctggacgcctacaataaaaagttggtcaagaagattgccgttaagaccgtggagcagactgcaaccacaggaacacaaggctacctttatctgcaagaactggttccgcaaaaatcaggttctcctaaggctcggattgagtttgaagtgcggaccaagtcaggcgatgtcaaatgggtgaccaaattggttgaagagccttttgctctttttgaagagtcaggcaacctaccagcctatcaaggcggttggaccttgagccattttgatgcgcgtgaaggtgaaaattccattcaaatcggtgccaatcgcaaactctatgtgggcgaagtgattggggaaaccaacgaagatgacatccgtcgtatccagattcgggaaaccattgccagtcacctgcaaaaagaagaacgcctttacaaacgaggtatcaaggtgctatcccttttcttcatcgatgaagttgccaagtataagtgctatgatgagcaaaatgatgcctacaatagcacctatgcccagatgtttgaagaagagtatgaagcccaggtcaaggctttattggctgatctcaaccttcatggaagtaacttttggcattatctcaacaagcaccaagaaggcaatcctgttcatgcaggttatttctctgtcgataagataaaaaaatcggataaggtcaagtttgtggactacaagtctgctacggaaaagaaaaataaccagtctaacgacaaggatgcctatgatttgataatgaaggacaaggaacgtctgctgtcttttgaggaacctattcgctttatcttttctcactcagccctcaaagaaggctgggacaatcctaatgtcttccagatttgtaccttgaaaaatacaggtacagaaacagaaaaacgacaaaagattggtcgtgggatgcgtctagccgtcgaccaaaaaggtgttcgtcaggatgaggagcttttaggagctgatgttcataatattaacaagttgaccgtcatcgccaatgaaagctatgaagattttgctaagaacttgcaaagagaactcagggaaatcttggctgatcgaccaagcaaggtggaagtggatttttttgtcaacaaggtcttggaaaatgaagctggtcaaaaactgactgtcaccaaggaagtggctaaagagattgaacgccagttgattaagcaagattatattgacagcaaggggaatctgaccgctacttattttgaacaaaaagaaacaagtcagtttactctatctgaaaatctggcaggctatgaagtggctgtaaaagatattctagaaacgatttacgatgccaatcgctaccagattgaacgtgaaaatgattcggaagtggtttttgcaagagaaatcaaccctgataactacaatcgtcaagagtttaaacgtttgtgggaaagtattcatcacaagtccacctactatgtcgaatttgatgatgaggagttgattgaaaagtctgttaaggccttgaatgagtccttgtttgttaaaaagcctagttacatgattacagaggctgaagcaagggaaatgcaggcgaaacacggtttggatttcaaggtaaataagaacggcaagcgtcagtctgtgctggataagtcttctattcaactccgctatgatttgctgggtgaaattgccagtcgcacggagttgaaacggaaaacagtcgccaatattttgaagcagatttcgccaagcaagtttgatatgttttcctataaccctgaggcatttatccaacaagttagtaggctcatcaatgagcaaaaggcgagtcaggtgattgagcatatccgctacaatatcctagaggaaacttttgatagttctatttttacggacaatcctttgagtggtaaggtgtcagatgcaaatatgctcaagtctgagaagggtgtttataattatgtgaaggttgattctggaacggagaggaagttcaaagaggacttggagcgattcgacgatgtcatggtctatgccaaattgcctagcaagtttaagatttccacaccgctgggtgattacaatccagactgggccattgccttccgagatggttcggtcaagcatgtttacttcgtagctgaaaccaaaggttccatgtctagtttgcaactgaaaggggcggagttggcaaagattgagtgtgcaaaggcccacttcaaagccctaaaagaaaaaggattgattgcggatgatcggatttatgatgtggttgattcctatgaaaaattattagaaatcgtgagaggataggttgctgagcaatccttctcgccactgaaggagaatatttatgggtgcgtttctgttttttacatttgcgatttgttatctggtgggcattgttgccatagtcaaggcttttgttgtcccctgaaagaggctgggcaaaaactagccgctcatacataaaaaactccaaacgcgatacaataaaggtattcaagcctattgtaaagcgagaggagaaaagtatggcacaaaaggcacataatttatcacatacaaagtggctgtgttctaccacattgtcttcacacctaagtatagacgaaaaatcatctataatcaatatcgaagtagtttgggagaaatattccggcgtttgtgtagttataaaggcgtagaaattatcgaaggacatctgatgccggatcatgttcatatgttagtcagtattcctccgcgattaagtgtatcaagctttatgggatatttaaaaggtaagagtgctctaatgatgtttgataaacacgccaatctcaaatacaaatttggtaatcgtcatttctgggcagagggatattatgtaagtacggttggacttaatgaagccacaattaagaaatatatacaagaataaagaaattatccagtggatgatttcttcacgagcttcagcttaaaaagcgagttaaacatgatatagcacttgataaattgagtgtaaaagagtatgaagatccctttagggataatggcaagtagtacgaatgcctctttaagaggctagtgacgagtcaaaagcagtgaggcttgaacaaagtgaaagccagcgtctttaggcgctggctggtgatgtgggcttatagcccttgttcaaaccacccgtttgacgggtggtttgaactttctaatttatgtgactcttacccaacaaattcgttgatttctttttcgatgttggagattttttcttctgcttcagcaagtgtttcaccaacggttgcgatgtagaatttgatttttggttctgttcccgaaggacgaacagcgaaccaagaatcatctgccaaggtgtatttcaagacatctgatggaggagtagtgagtttttcaatgtttccatctttgtctgtcttagtttgaagggcaaagtcttcaaagaccgcgatgtcagtagcgttgaattgtgctggtgagttatcacggaacttagccatgattgccttgatttgttctgcaccatccttaccagaaagggtaacagagattgttttctcagcaaagtagccgtattctttgaagatttcatcgataccgtcagctaaggtcatgccacgtgaacggtagtaggcagcaatttcagcaaccataagcacagcctggatagcatccttgtcacgtacaaatggtttaatcaaatagccaaagctttcttcgaaaccaaacatgtaagtatggttgtgtttttcttcgaactcttggattttctcagcgatgaatttgaaaccagtcaagacgttgaacatggtagcgccatagctttcagcaatcttagttaccaactcagtagatacgattgacttagcaagggcagcgtttgcaggaagtgtacctgcttgcttgtgggcttcaaggatgtacttagcaatgatagcgccgatttggttaccagacaggttccagtaagaaccgtcagcttgacgaacttcaacaccaacacggtcagcgtcagggtcagttgcaagaaggacatctgccccgacttcacggccgagttcttctgcaagggcaaaggctgcttggctctctgggtttggtgaagcgacagtagagaagtcaggatcagcagttgcttgtgcttcaacaacttggacagattcaaaaccagcctgtgcaagggcacgacgcgccaacatttcacccgtaccatgaagcggtgtatagacaatcttcatgtctttaccgtattcagcaatcaattcagggttgatgttgaggtcattgagttcttcaagatatttaacgtcagtttcttcgccaagaaccgtaatcaaaccattttccttgctggcttcaaggtcagccaattcaactgcaaatggattgtcgatggcacggataaagttggtcaatgcatctgcatcagcaggtggcatttgtccgccgtcttcaccgtaaaccttgtagccgttgaattctttcgggttgtggcttgcagtcaccataatccctgcgatggcattgtaatggcgcacagcgaatgacaactcaggagttggacgaaggctttcaaatacataagatttgataccatgcgctgccaaaacttgagctgattcaaaagcaaattctggcgagaagtgacgtgaatcgtaagcgatggcaacaccacgttttttagcttcttcaccttttgattctaccaattttgccaaaccttcagtagcttgacggactacaaatacgttgatgcggttggtaccagcgccaatatagccacgcataccagctgtaccaaattcaagatttgtatagaaggcatcttcttttgttttttcatccattgcgactaattcttcacgcaagtaatctggaaggtccgcaaagtcgagccatgtttgataggtttcttgataagtcatcgcatatctccttaaaaatttttctattaaacgctttcattataccatgtttgaaaagaaaaatcacgctttcacatgattttctgatatttatttttgaattttctgtaaagttggaacaagcgctgcagttaatacagaagaaatgatcatttctgcaattgaattggtacctaaaacggttgctaacattgcttgaatattaccatcaaagacagaggagaagaggaagaaaatacctccaagtacaaaaatagtattggtcattgaaccaattgcaccagcaataaataatcctttacgattttttatccatttgtagacgaaataaggtgtaatcccgactaatatacgtgggacaactgcaatgatgattgaataaacattaccattttcaacaaatggggagaaaagatagctggttggtagtaagataatagtattatgggtcatactcattaagcccatgagagcccccaaacaagccccaacacgtggcccgtatataatagaagcaataatgactgggatatgtacgatggtgggttttattggaacaggcaatatattaaaaataattgaactcaatatattgatgacaatcatgacagcaaagaagattgcaattgtagcaatttgagttgatttattttttttcatcaagggtgttactcactttctctaaaatatcagttacctcagccaaggccccagttccaaaatctccacaagcaagcagggcttcacgcggtttgatttcctcaaaaccatactctatgagggttttgatatttttctgggtagcaggattgaggtacatgttagtattcatagcaggtgccagcagttttttagtaccaattggcagagccagcgctgttgccgtaataatgttgtcagccataccattagctaatttagctatcgtattggcagaagcaggggcaactaaaaatacgtctgtttctttggcaatatcgatatgcttgataagagtaggattttcttcaatcatgacatctgtgtggaccagattttttgacaaggattggagagtcaaaggtgtgatgaagtccatagcagagcgactcatgaggactgtaacctgatgaccgatcttggtcaattgactagttaggtccgctgctttgtaggctgaaatagagccagtaacggcaagtgtgatattagccattttgttctcctttttctagggtatttaaaatgagctgagcaatttcatcttttgtctgtgcttgaatctcccttgttttatcaaccaaataggcaatgtgttgattttctccaatatccttcaagtcattagcaagtatataatcagcgccatttcgttcaatgctttggcgagctacggcaaataattcctccttaggaacattaaccaatagtttgaagccaaagagtgtgatagctggattccatttttttacataggaaatgaccttgggagtttttttcaagaaaagaacttggtagtcatccttggatgaaatcttactttctgtattctgtttttttagtagactagaaatgtcttcagttgctcttagttcatctaaaccagccatataaacaggtgtataatcggatacagccatgctatgaatcagagcctgatgtgttttgactaaaggttctaatgtttctttcaaactatcaacatttgtgatttcgataatggttaaattcttctgagaatctggtttaacagcctgtcttgtagtcacaagagtaacttcatgaccgcgtttcaaggcttgttcggcaatgatttttccaagatttccagaagcatggtttgtaatagcgcggacttgatcgatagcttcgcttgttccgcctgatgtaatcaatagtttcatgttcatattttactagaatttctatttttcgtaaagtttgtactaatctatttgctaatcaatctgtgacactggaaaatgatgctgctaatacaaaaaatataagggcctgtattatatagtgaagtgtttttgtgcaagaaagcgttggtttgttaatcaaggcaatttttaaaggaatactgactctcttttgaaaaaactaactaaaaccagccttagatggaagtgtagagctatgatgagaatgcagtttttaaaaatttgtatctgtttaagtaaggaaacctgtagtttttctgaaaattccgtacgttagtgaataaatagtaaaaaaatatgcgaaaataagttgtagtatggtataatatccataaaaaataaggaaattaggtactctcatgaaaacagatattgacattgcacaaagtataaccttgaaacctatcacagagatcgttgaaaaagttggtatcagttttgatgatattgaactatatggaaaatacaaggcaaaattgtcttttgataaaatcaatgcggtgaaagacaatgcgccagggaaattgatcttggtgacagctatcaacccaacgccagctggtgaaggtaaatcaactattactatcggtttggcagatgccttgtctaaaattggcaagaaaaccatgattgccctccgtgagccttctttgggacctgtcatggggatcaaaggtggagctgcaggtggtggctatgctcaggtcttacctatggaagacatcaatttgcattttacaggcgacatgcatgccattaccacagcaaacaacgccctttcagccttgattgataaccatatccatcaggggaatgtgattggcattgatcaacgtcgtattatctggaaacgtgttgtggacctcaacgatcgtgcccttcgtaaggtaacagttggcttgggtggtccgctcaatggtattcctcgtgaagatggattcgatattaccgtagcttctgaaatcatggcgattttatgcttggcgacagacatcaatgacttgaaagaacgtttggcaaatattgttatcggttatcgtttcgattgcagtcctgtctacgtgcgtgatttggcggtggaaggtgctttgactcttattttgaaggatgctattaaaccaaaccttgtccaaaccatctatggcacgccagcctttgtccatggcggtccatttgctaacatcgcccacggctgcaactcagtcctcgctaccacaacagctctgcgtttggcggactataccgtcacagaagcaggatttggtgctgaccttggagcagagaagttccttgacattaaggtgccgaacttgcctaaggctccggatgcagtagtcattgttgccaccctccgtgcacttaaaatgcatggtggtgtagctaagacagaactttctgctgaaaatgtagaggcagtgaaagctggtttttctaacttgaagcgccacgtggaaaatatccgtaagtatggtattccagctgttgtagccattaatgaatttgtgtccgacaccgcagcagaaattgctgttctcaaagaactctgtgccgcaatcggtgtacctgtcgagttggcaagtgtttgggcaaatggtgctgatggtggtgttgaattggctgagacagttgttgctactattgataaccaagcagccagctaccaacgtctttacaagtctgaggatagcttagaagagaaagtgaccaagattgttacgcaaatctacggtggtacaggcgttgtctttgagaagaaggctcgtaaccagctgactgaatttgctaagaatggctgggataagttgccagtctgcatggccaagacccagtacagcttctcagatgatcagtttgcccttggagcgccgacagactttgacattacagtccgtgaatttgtgccaaaattgggtgcaggctttatcgttgccttgactggagatgtcatgaccatgcctggtttgccaaaagctcccgtagctctcaacatggatgtggcagcagacgggacagctatcggcttgttctaacaagaatgaatataaaaaatccgctcaaaggcggattttttgtctattcagatagtttctcaaccgttcgataggcaagtaagccaagggaaatactcaagataggaaacaccgtctggaagataccagtgttgaatggtgaattaaagagaaaatggattccaaagcttgcaccgatccaaaatactccctgtgcttttgacatacctgtatttttcgtgagaagggctactaagccaatggcaaagagaagcgtgaaaacccaatgggcccaaccagcttgaccaacgcgttcaagaatagtttcaaagccgtctaatttattcatgaacatgtctctaaaaacaaaggtgatgtcttccatgatttggaaacctaatccaacaatcactccgcttaccaatgcattttttagtgtcatttttctacaaataagcagtacaagtagaacagttagccctttaccgatttcttctgccaatggacctgaaatagctgcaccccagtcatttaggaaatcattactagctttaacaatttcgagcaggaaatatccgatagctgtatgtcccagttcagaaaaagagatgctacttgttaagcctaaaagccagctaagccctataacttgtttggagatgttatagcgtttagctaaggaatatgtcagtactagtaggggaatgaggtagatagcgaccaaggaaatggttaggagaaagagagaatatttagcttccatgccatttggcttacctaattctccaaagataattttgcaaccgttgacaaatccaatcgttgctaagacgactggaagataagttttacacatttgaaatttttctttcatagtttgacctttctgtattaataaactagtgtacggatacattgtatcaaaaataagtacattttgtctattattcacctattttttatctaaaccttctcagttattgtaatgttttttcctgcaactaggactccataataggccgtagcagaattgtgccaaaaattttcttttttgatagactaatgttgaaaaaataaaggagtattttatggaacaatatgatttagtagtcattggttttggaaaggctggtaagaccttggctggtaagctgtcagcagctggaaaaaaggttgccttggttgaggaaaatcctgttatgtttggcgggacttgtatcaatattggctgtattccaaccaagaccctcttggtagcagcagataaaaactggacttttgagcaggtaatggagcaaaaggaaacagtcaccactcgtctgcgaaacaaaaacgaggcagtcttgaaaggcagtggtgctaatctttatcaaggtcacgcgcgttttgttgcggacaaagtcgttgaagtgtcggccggtgaagagtcgattcaactgactgcggaaactattgtcatcaacacaggtgctaagtcgcgcgtgcttccaattccaggtttgttggatacagctcacgtttatgatagtacaggcattcagaacttggaaactcgtcctaacaagttggcaattatcggtggtggtaacattggattggaatttgctggactttacagcaaactcggcagccaggtgatggtatatgaagccagctctgctattttaccaagagaagaggaaggagtcgctcagctagccaaggagtatatggaagaagctggcatgacctttgtcttgggtgcgaaaatcgagcaagtcgcagctgcgggcgagcaagttgctgtgacggtcaatggcgaaacagcaattttcgacgctgtcctctatgcgacaggtcgggtgccgaacactgctgacttgggcttggaaaatacggcgattgagcttttggaaaatggtgctgttaaggtggatgactaccgcgaaacgactgttccaggtgtctatgcggtgggagatgtcaatggcggtccacaattcacttacacatccctagacgacttccgtatcgttttcggcaagttgactgggactggaacttatagcttgagccaacgtaagtctattccgaccagcgtctttatcacgcctgtgctttctcgtgttggtctgaccgagaaggaagccaaggaagcaggttacgactacattgccaacgaattgcttgtcgccaatatgccacgtgcccatgtcaataatgacctcaaaggcattttcaaggttatcgtggataaggaaagtaagcttgttctgggggcgactctctttggtcgcaattcagaggagctgattaacttgattgctatggcgattgacaataagattccttatacctacttcaaaacacaaatcttcacccatccgactatggctgagaatttgaacgatgtctttaatttttaatagtgtaataaccgtccaatagggcggttttttgtcggtcagcacttgcaaatatggtataatgattgataagaaaagactaggagagttgtatgataagaaaggaacacaatgagtttacaagagttcagttgccagctgctttgcatttgactcggcttggatatgactatctttcggctacaagtgaagacataaaaaacagagaccattcaaccaatatccttctatcaatttttaagcgacagtttttaacattcaataattacgcaagtgaagctgattttgaacaagaatttgaaaacattcgcctggaattagaacaagatgatttaggacgaagtttttttaatcggattcatgcagattctggctacacctatatcaattgggataatatggaagagaataccttccatatagccttagaagtcacctgtcaaaatggtgaggaagagttccggcctgatatcaccgtttttatcaacggtctccctctcagttatatcgaagtcaagcaaccagatgctattcgtgatggaaaaacaggaattcactctgaaaaagaacgtgccaagctccgctttgaaaataaaaaattcagacggtttaacaatatcacacagttgattgctttttcagacaatcttccctatgatgatagccaaggacaacagttgcaaggttcttattactgcaccaatgcttcatctggtaccaagttcaactctttcaaggaagagcaggagggacaagtacagtctagcctgtctagcttaacagaagagatgattgatttggttctcacagatgtcaatcgttttgccctcaagtcgcaagttgaattccgaaccaacttggatcctgcaagtccttgcaattcctttttaacttccctttatcagaaagaacggctctttttcatgctccgctatggtctagtctatgtggaagaacgagatgagcatgaccagattcaactacaaaaacacgccatgcgctatcctcaatattttgcgaccaaggcaattgagcgaggattggaagaagggatgaagaaaggtgttatttggcatacacaaggttctggaaaaaccgctctagcatttttcaatatccgatacttacgagacttttatgctaaaagaggtgttgtcccgcagttttactttgtggtagaccgattggatttggctgatcaagcctataaggaatttagcaagcgtggtctcaaagtcaaacgaattaacaaaccaagcgagttaaatcagattcaagaccagcaccatgtttctgttgtcaacatccaaaaattcaaagaatcctctgatttgacagatcattcaggctatgacttgaatcggcaaaatatctacttcattgatgaggctcaccgttcttacaatgaaaaaggttcctatctgccaaatctatataatgctgataaagaagctgttaaaattgcactgacaggaacgcctttgattgcgacaaaggctgacggtaaaaccaaggaaacagctgtgacgactcgtgatatctttggggactatatccacaaatactactataatcaatccattgctgacggttttaccctacggttgatgagggaagatattgaaacttcttacaaggaaactctacaagctgtacacgaagagattcaaaaaggctccattgaaaagaaagaaatttttgcccacccccgttatgtctctccaatgctagactttattcttgatgattttacaagagcacgagagatcttatttggcgaccagtctatcggtggaatggtggtctgtgattcttcagaacaagcccgagaattacacaaacagttagaagaccgtcgaaaagcagggcttacatcattcacttcaaccttgattttacatgatgctggggataaggaatacaagaaagaagaagtggataaattcaaggacggtctgatagactttgtcatcgtctactccatgctcttgactggttttgatgcaccaaggctgaaacggctctatcttggacggaaaatcaaggcccataatctcttgcagaccttaacccgtgtcaaccgtccgtacaaggattatgcttttggctatgtcattgattttgcggacatttccaaggaatttgacaagaccaataaagcctatctggaagaactcaatcgggaataccaggcagctttgacagaagaagacggagataatccttttggaactatttttgtgtccccagaagaagtccaggaacagctagcgagctctaaccgagttctaatgaactatccgacagataacttagaatttttcggaagagccatcgatgaagtcaaggataggaaagagttaatcgccctccgaaaatctcttgaaaccattcgtcagtactacaacatggcacgtttgcatggttaccacgatattgtcaaacaggtcaatataggagaaattgctagccttttaaatatgctgtcccgccgcctcttgactttgaacttgttagaaaaaccagatagtttttctagtcagcaactactgaatctagccatgtctgagactagctttagttttaccaagataaaggaagaggaactacgactggcagccaatgatttggacgatatccgacgccgtgtggccaatggtatcaatctacggagagatgaaaaagatcctgaatgggtaagtctttatgaagagtttcaacgcatcctaaacaagcacatgacacaggaagtagaaggatatagtctctcaaccattaaagaaaccaaacaagcctatcaaagtttattcgattcagtagaagactataaaacaagaatgaatcgcttggccatgaactttggtggagataccatgtctgcccgtgcctttaagcacattacccaatcaacagttgtcagtgacttcccagctatttatcaggtgctaaaaggtgccaaacctctgattgattatcaaatcgggctcaatcaaggcattctggaaaacgaagcctatttggtagcgcagatcaggcaactggcccgtaaagaaatgatgaaaacagaagtagggaagcaactcaaacgagtcgattatgataagttgattcgttccctaatggaagtctatgaaggagaatattaaacaaatggaagaacattatatcgtgcaggtgcaaagtcaagtacaaggcttggttgatgacctaaaagccgtctttacccatgcaggacttggaggagaagcgggggagtacaaacttctgacccagtccttcctttacaagttcttaaatgacaagtttttgtatgaagccttgatcgttgacaatcgttatgactatcaaggtcttttggacttgtctgaagaagattatgactggtttttagatgatattgggactaaaactgctcatctaaaacctgaacagctgattgaaagcctacaccgtcaacagaaccaagcagattttgctgagatttttgaacagactctcaatcagattgctattgacaacaatgctattttctctgtccatacggacggtggaacagatattcgcctctttgatcaacgcttgattacggatacgatttcagatgccagcaagcgaaatgaagtggcagcttctattatcaatctcttggcgcgtgttaagtttgatcagcagattttttcacagggctttgactttttctccaccttgtttgagtacatgattaaggactataacaaagacggtggtggaaagtatgcggaatactacacacctcactctgttgccaaaatcatcgcggccattttggtgggcaatgaccaaccaagtaatgtcaaaatctatgatccttctgctggttcggggactctcttgatgaatctggccagtcagattggtgatgaatctggccagtcagattggtaccgaccgtaccagcgtttacagtcaggatatttctcagaaatcctccaatctcttgcgtctcaacttgattctcaatggcttgcagcattccattcacaatatcgtacagggaaataccattctcaacaatcgtcatgtggagaagatggactatatcgtgtccaatcctcctttcaaattagatttttctgagtggcgagatcaggtagaaagcctgccaaatagcagtgaacgtttctttgcaggtgtgccaaagattcccaacaagaaaaaagagagtatggctatttaccaactctttatccagcatattatccatagtttgaaggaagacgggcaggcagctattgtcttgccgacgggctttatcaccgcccagtcaggtattgacaagaaaatccgtcagcaccttgtcgatgaaaagatgttggcaggcgttgtgtccatgccgtccaatatctttgcgaccacaggcaccaatgtgtccattctctttatcgataagaagaataaggacgatgtggtcttgattgacgcttctaatcttggcaccaaggtcaaggaaggcaagaaccaaaagacagtccttagccctgatgaagaaagccaaatcattcagacctttattaacaaagaagttgtcgaagacttctctgtcaaggttagctatgaagagattaaggataagaactactccctcagtgcaggtcagtactttgacatcaagattgactacgttgatattagcccagaagaatttgaagaaaaaatgcagggctaccaagaccgcctagctaacctctttgcccaatcgcatgaattggaaaaggaaatagcggagcaggtgaggggggtgaggtatgagtgaggtaagatggcaaataaagagtttgtctgaactgggaagattttcaaggggaaaatctaaacatcgtccaagaaatgataaaaaattatttactaatggaacctatccgctaatccagacaggtgatattaaaaattcaaatctttatgtaacaaagaatagtgattattataacgaatttggtttgtcacaaagtaagctatggaagcaagggactctttgtattacaatagcagcaaatattgctgaaacagcgattctatcttacccaatgtgttttcctgatagtgttgttggttttaatgcacataaaaatgaatcaagtgagttgtttgtttattatgtttttgaattaataaaaaaagaaattcagaagacatctagtggtagtatccaagataatattaatatcgactacttaacaaaattaaaattaaaggttcccaacaaagattatcaagatagaattgtcaacttattgtcaactattgataaaaaaatcttaattaataaccaaatcaacgaggagttggaggctatggccaagacgctttatgattattggtttgtgcagtttgatttccctgatgaaaatggtaagccctacaagtcctctggtggtaaaatggtctataacgaccaactcaaacgggaaatcccagaagggtggggagtgaagcagttgggtgagatatgtgaatttagaaatggaatcaattatgaaaaatctgagacaggggatacgctttcaaaaattgtaaacgtacggaacatttcaaattctagtacttttgttactactcatgatttggactcaattactttagatagaagacgtattgaaagctatcttgttacagatagaacaattctgataactcgcagtggaattcctggggcgactaggatagtctctgatattccagttaacacaatttattcaggttttattattggtgcaactgttgccaatttgaatctattttattatgtattttatcatctaaagaatattgaaatgctcatgtctaatcaatctgcgggaactataatgaaaaatatttctcaaactacactttcagaaattcgcattgtgatcccaaataaagaaattcagaaggtattttcaaatgaagtcagaagtcttttagatgtaattgaaaataatttaaaacaaaaccaagaactgacccaactccgtgattggctcttgccaatgctgatgaatgggcaggtgaaggtagaggagtaacgaaaatagaggtttatgctatgagtgaattaagcaaggtcacgatcagaatttctggtaaagcaatggatgaatctaaaggttacgaacttaaatatttgttaaaatctttggatagtttttccaagttatcagaaaagacgtatttacatatgataagcgaagataggctcaaaaagagtgaaagtggtaattttgcactatatattgacaattttcaacatggttctttcttagctgatttagtaattgtaatgaattcatatgcccttcctttacttgaacatggtcaaactatttggggagctatcacaactgtttatgattttataaaaacaatttcctctgccaaagaagaaggtaaatcggtaagtattgagaatgtcggtgatggttcaatagccgtagcggtaagtgacagttcaagtgttggagatattacaataaataactatctatatccagaatatgtaagagaattatctccaaaacttgctccctctttctccaaattggttcattctattgatgaaaatattgatgaaatctcatttaattctagtgacggtaggggcttcaaggttagtgagaaagatataaaaatatttgataaaaaagaatttctttcttccgaagagattcaaatttcgggcacaattacagttttaaatacacatgataacactggaaaaatacaaattgaatcaaatgaaattccgttgggtgaatataaattcgatgttcaaaaacagattcgctaccctgaataccttagttcagctatgagaaagaaattgagatatagatgttatcctaaaataaatttcgatccgtcaactttgaaagagaaagttattggtgtgcggattattgaaaaattgtagttcaagaacattcaatactttcagaaaataccccctaatcatgttgactagggggtatttttctaagtcgtttctatctcttttccttgcggtaaggttgttacaatgtttattgtagcggagttagtttctgtttgatttttctgtcgcgttctttctgaaaaatcttggcgaatatcatttaggacttgcaagataactttttcaggggctgttgggtcatagctgattttattgaccaagtgactataaaggagggtgtacagattgaaggctgtttttcggacttccaagctgtttattttttcgcgagtgctggtgtcctgacttcttttcagatagagacgatatgtactttcatggctttcacggagattggcaatagcttcatctaacataagtaggctaacatcttctgagtagggtggcttcgccagtcgggctagcaaagaatcaatcaaagcagatgattcttgcatattggtagaccttgtatttttgtatagtttgatgagttcttgtagtcggtgataggcttgtaatttctcgggtgtccgagtatttttaaaaagtttgagtccgttgacgaaggcagagtagtcagcctttcgattctttagagccttgtttaagttactagtcatgtctgagccacgtttttgtttgagactttttttcagtaagggtaaggattcttcaagctgtttgattaagtccgttaccatggggtcattggtggaagaactgtactgtttcaaggtatcaacactacttgtgatcaattgtgtaaattctgcttgattcagatgttgtgcatataaagggattcggattttcatttgtgtacctcactatctttttttccggtcatcttatttattcgtaaataagtagaaaaaaatagaattatttaaaaaattttttaaaacttgtcaaaacagtacatttacctataataaaattgtgtttttaaggaattgcatcaaaacacaatgatataaatgtttggaaatagcaaattagtttgacttgcatatttaaaaattgtttttggaataaaattattgattaggcttgttttcaaattgaaaggatatgatctcagtttgtttattgaataccttgcacacatttttctttgtttaggcaattccgtggtacaataaggtatcaaccattggaggttttatatgaaatggaataaaaaactagcacttagtgctgtcttagtcgcaagtttgtttactttgtcagcctgtcagtcgatttcaaattggtggaaaaataccaaggaagaatggattggcttggagatgacggtacggacttatgatgaaaattctcagttgatagatgaaatgtctggtaagtccctatcgatttcgcggaatcaggaatttgactcggtggatgccgaaggctattccaatgcggattcttctgtcttgaaggtgacacttgggaattacgaaattgaccacgtaggctcatctttgattgcggcagaagaaggtttggaagacttgtatgcgaaatatcagaccacagtagatatcgcaaattacgatcgtgcaattccgcttgttaaccgtatggtatctagtctcaaaaatgattttacaggtaaggcaaaggtggtcttgattcgttcgcaaaacggaaccccgcttgctacttatgtaggtgataaagtatctctttatgcatctgatgcacctaagacttctgaactcttaattgatggcaagcggttgattatctaccgctgtgattatacaatttatgatagagaattattggagaactaaatgatagacattcgttccgcaaggatagaggatgcggcagaccttgtggcaatttatgctccttatgtagaaaagaccgctattacctttgaaacagaagtaccgactgtcgaagcctttgcaagtcgaattgaaaagaccttggagaagtttccctatctggtcgcagtagaagaaggtaaagttgtgggttatgcctacgcttcaacctactatgcccgtgcggcttacgattggacggtggaattatccgtatatatcaagcaagaagcgcgcggaaaaggaattggaactcttctctacaatgctttggaaaaggacctgacagcgcgtggttttaaaaatttcttagcctgtatcgccctaccaaacgcagcctctatagcactccatgagaagaggggctatgaacaggtggctcatttcaaaaaagttggttataaatttgatacctggcatgatattgtctggcttcaaaaatctcttgtaggtaagcaaaatgaagattaacgaattagaaaaacgtttgttggccgtggcggatgctagtcaggcccagcctatgaaagcttatatgaaaaataactttgaattcttaggtgtacgaacgcctgaccgccgaaaagttgccaagcagtttttcaaagatttcaaggctcagggaattgactgggactttgtagaggcttgctggtctaagccctaccgtgaatttcaatatatcgctattgattacctagttaccaagaagaaagacttggttctagctgatttacctcgtttgaaagagctagctcagaccaagtcttgatgggatagtattgacggtctagataagctagttggtaagattatcttggaaaatccagaggccaagcagacaatcttggaatggagtttggataatgatttctggttgagacggattgccattgaccaccagcttctccaaaaagaaaagacagatacgaaactgttggaacaaatcctaatcaataatctcaatcagactgaattttttatcaataaggcaattggctggagtttgcgggattattccaagaccaatcctgaatgggtacgagtttttcttaccaagtacagctcacaaatggcaggcttgtccattcgcgaagccagtaagtatatctaggaggagccatgtccaaagtctatgaatttgaaacccttatccatccagtaccggataagggcggagcctatatcatctttccctatgatatacgagaagagtttggtaaggggagggtaaaggtacatgccagatttgattgtcatccctatgatggctccattgtcaatatgggagttaaggatgaagcaggcaatatctgttatattattggcgttcaaaaggctattcgagcggctattggaaaacaggctggtgatagagtacaggtaaccattcaagaacgaatggagtaatcaggcttgcaaatccttgagattatggtagaatagaatcatgcgatgagccgagtagtggggggattaaggttcagcacacttctaagagttcgtgtcaacatctcagcgcagtggttgattggcagatttgttcgtattttatactccaaatctgacctaatcaactgtgcgggggtgggaagacgaactcttggttgacaagttgagttctttcccactcccttcgacgctagggaggtcttcatttaattgaaacgcaggagcggaccttgaatagttgtgtgaaccttctattctcatcggaaacgatgcccttgcccacctttatggtgggctttttgtatactaagtgaggctgggcaaaaagccctggcccacttctcagtgttcgtgtcaacatctcagcgcagtggttgattgggtttaacagtccagtggactgttaaaggtaggagataagatttgcgaagcaaatctcagcaattcgtgttttacactcgaaatctaacctaatcaactgtgcgggggtgggagtgaaacagtctggggatagactgtttcagctcaacaacttaaaacgaaaaattgttgacgaaccttttttgacttagtcgatgtctttcccactcccatttcagtatgtgatttctataggaatgctattggctcagccgaggaagtttttatatttctcaaagttagaaataacagttgatattatgtttgatgaagattgcttgatagtcttttaaatcttctggatggagagccttgacatcggtcatagcataggttcgattgagaagcttatacttattttctccaaattgatggaaggggagtagttgaactttgtcaatcttgagttgattaaagagacaggcgaattgttcagcatcttcgagggaattattaaagtcagggataacagggatacgtaggacgatttctttcccgatggaaaaggcgtattggatattttgtatgataaggttattattgacgccggtgacttttctatgagaaattgtattgtaatgttttaaatcagtatagataaagtcaacgtattggataaggtcaacaaatttgtggtgttctacgaaagcggtggtttcaatagcggtatgaaggccgtgtctttttgcctccataagaatagctttcgcaaactcatattgggcaaaaatttctccgccagacagcgtgagcccaccacctgattcttcataaaaatcaatatctttcatgacttcggatatgatgtcatcaacagatttttcttctcccatgatggtcatttttttactaacagcatcaagcatgggttcaggttttcgtttttgagattctggatttgcacaccaaggacaacgtagggggcaacctttcaagaaaaccgtcgtacgtataccaggaccgtcatggagcgaaaaatgttgaatgttaaaaataatgccttttcgtgtattcatgctctttctccttttcgattaatttgattttatcacacaaaagaaagttttacaattacgaacgtaagttaaaaagttgcaaatagttgaaaaagagtcaaaatttgatagaataatgatgaggtgatgaaatggaacgattagataaaattatacaactggtatcacaacatgaaaaaatagatgtcaatagcttggcggagcaactggacgtttctaaggtaaccatccgtaaagatttagataagttagaatcaaaaggtttattacgtagagaacatgggtatgctgttctaaatagtggtgatgaccttaatattcggatgtcctttcgctatgatgtaaaaaaacgaattgcaaaagaagcagcaaatctcattgccgacaatgaaacgattatgatagagtctgggtcaacttgtgctctcttggcagaagaaatttgcaaaaccaagagaaatgtgaccatcataacaaattcttattttatagccaattatgtgcgacaatatgatagctgtcagattattttattgggtggtgagtttcaaaaagattcccaagtaactgttgggccgctcttgcataaaatgattcagtttttccatgttgataaggcttttgtaggaactgacggctatgatagtgagcatggttttacaggtaaaaacttaatgcgaagcgaagtagtacagtacatgtctgacgttgctgaaaacatgattgtgctaacagattctagtaaatttacaaaacgagggacagtacgcagatttggtttaagtcaagttgctcaggtcattacagatacgtcgatttctgaagatcttgtcaaggaattagaaaatgctagagtcacagtaaggctagtttaggttgggggcagtatgaagcaagaaaaaagaaggcagttggcaaaaatagcctatctttactacgaagaggggaaaagccaagctgagattgctgctgatacaggaatttatagaacgacagtcagtagaatgttgaccaaggctaagtcagaaggcattgtaaaaatagaaattcaagattttgataggcgcctatatcgactagaaaaatatgttcaagaaaaatatggattaaaaggtttagaactggttgaaaacagcaccgatgaggaccagcttgatttagaaaatcgtctggcacaggctgcagccgatatgcttaccaatctaattgatgatggaaagaaagttggtttttcatgggggagaagcctcagtcttattgtagataagatagggaatcatcgtatgaaaggtgtcaaatttgttccaatagctggcggtccaagtcatatccacgcacgttatcatgtgaatactctgatttacgatatggccaataaatttcgtggagaatgtagttttatcaatgcgacgattatccaggagaatcaagaacttgctcaaggtattctttcttctaaatatttcgaggagctacgtgctgactggaaggacttagatgtagcagcaataggtattggcggtcgagtcgatgaaaaaaatcgtcaatggttagatatgttgacgacggctgattttcaagccttgtcagatgaaggtgcagtcggtgaaacctgctgtcgtggtctgaatcaatacggtcaagctgtcgtggaggatttgcaaaagaggaccattgccatctctttagatgatttaaaagaagtcccagatacaatagctcttgcatatggggaggaaaaggctcaagccattttagctgtattgcgagctggctacattcatcatctggtaacagatgaacgaaccatcgtaaaagttttagaactggataatgatgtgcatgtccatacaaatttgtaagagagtacttcaatcacttaaaggtggttgaagtattttttatcccaaaaaatgcacaaaagtgcagaaataaattaaaacagaaaatgttctataaatatatttacgctataaagagaaaatgatatgatttacttacgaaagaaatataataacttacaaataaaacaaatcggaggaaaaagaaatggaaatgattgttgcagatcaattgatcatgggattgattatttatgctggagatgcgaaaagtcacgcctaccaagctttgtcgcttgtcaaagcaggtgaagaagagcgagcagaagaggaattagaattggcagatgcagcattattagaagctcacaatatgcagacaaaattcttagcacaggaagctggtggagcaaaatctgatattacagcactatttgtccattcgcaagatcatttgatgacgtctattacagagatcaatttgattaaagaaatcattgatttgcggaaagaactaaaaaaagttggctaaaacaaaaaaattatatttaggaggaaaccgaaatggttaaaatcgctctattttgtgccgctggtttttctacaggcatgttggtaaacaacatgaagattgcagcagcagacgcaggtgtcgaagtagaaatcgacgcgcattcccaagggaaacttgcagattaccttgacgaaatcgatgtagctttactgggaccacaagtagcatatacgcttgataagtcaaaagcgctctgtgatgaaaagcaagtccctattgccgtgattccaatggcagactacgggatgttggacgggaaaaaagttcttcaattggcactcagcatggtttcataaaggagtatggtcatgtccaaaattgatacacaaaaaattattgtcccaatcatgaaatttgtgaatatgaaagggatcatcgctctaaaagatggtatgttggctatcttacctttaacagtagttggtagtattttcttaattttggggcagttgccttttgaaggcttaaatgccgcaatagcttctatatttggagcggaatggactgaaccgtttatgcaagtctatagcggaacctttgcgattatgggcttgatttcttgttttgcgatcggctattcttatgccaaaaatagtggagttgagcctctccctgcgggtgtactgtccttgtcttcattctttatcctcttgaaatcatcttatattccagttgatggagaaccaatcggtgatgccatcgcaaaagtatggtttggtggtcaaggaattatcggtgcgattattattggtttggtagtgggcgctatctatacgacttttattcagcgtcatattgttatcaagatgcctgaacaagtaccgcaagctattgccaagcagtttgaagctatgattccagcttttgtcatctttttgctatctatgattgtctatattgtttccaagatggcgacaaacggtggtacattcattgaaatgatttacgatgtgattcaagtgccactacaaggtttgactggttcattaccaggtgcgattggaattgctttcttcatttccttcctctggtggtttggtgtacatggccagtcagttgtcaatggtgtcgttactgctttactattgtcaaacctcgatgccaataaggcccttttagcagcagataaattgtctctggaaaatggcgcccacatcgtgacccaacaattcttagatagtttcttgattatgtcaggttcaggtattaccttcggtattgtttttgcaatgctatttgccgctaaatcaaaacaatataaggctcttggtaaggtagcggcctttcctgcactctttaacgtaaatgaaccagtcgtctttggttttccaattgtgatgaatcctgtaatgttcttaccatttgttttggtaccgatcttagcggctttcattgtctacggtgcaatctcaataggctttatgcaaccattttcaggtgtgaccctaccatggtctaccccagcaatcatttctggttttatggtgggtggttggcaaggtgcagttgttcaaatcattattttagctgtctcaactattgtttatttcccattcttcaaaatccaagataagattgcctatgaaagtgaaacgaaagaaccagtttagtcaatgatgtcagacaaaagagttgcacaaatgtgcagccggcttcggaaatcttagcgctcactagcatcaattgacaataacccctattacaggatatacttaatttacaaacgaaacaaaattaagtttcgaaagaaagggtaaaactatgaaaacagtgactgaagtagctggcactagcattaaaactgagtattttggaagtctgactgatcggatgaacaaatacagagaagatgtccttgataagaagccctatattgacgcggaacgggctgttttagcaacaaaagcctatcaagaacatagagagaagcccaatgtattaaaaagggcctatatgctcaaggaaatattggagaacatgacgctttatattgaagaagaaagtctgattgcaggtaaccaagcttcttcaaataaagatgctcccatcttcccagaatataccttggagtttgtattgaatgaattggatttattcgaaaaacgggatggggatgtcttctatattaccgaggaaactaaagagcagttgcgcagcatcgctccattctgggaaaagaataatcttcgttcacgtgcaggtgtcttgcttccagaagaagttcaagtttatatggaaactggcttctttggtatggaaggtaagatgaactctggcgatgcccacttggctgtcaattaccaaaaggtattggaacaaggtttgcgtggttttgaggagcgagttcgtgtagcaaaggctaatctcgatttgacggatcctgcaagtattgataaatatcatttctatgactcaatctttatcatcattgatgcggtgaaagcatacgcagatcgttttgtcgccttggctactgaattggcagagaaagcaccaacagctcaacgccgtcaagaactactggagattgcacggatttgtgcgaaggtgccgtatgaacctgctgaaacatttgcagaggcagtgcaatcggtctggtttatccagtgtatcttgcaaatcgagtccaatggacattctctatcctatggacgtttcgaccaatacatgtatccgtatgtgaaagctgatttagaagcaggacgtgaaacggaagacagcatcgtcgaacgcttaactaacttgtggattaagaccattactatcaacaaggttcgtagtcaatcacataccttctcatctgctggtagtccactataccaaaatgtaaccattggtggacaaacacgtgataagaaggatgctgtcaatccactttcttacttagtattgaaatctgttgcccaaacacacctgccacagccaaacttgactgttcgctatcatgcaggcctagatgctcgcttcatgaatgaatgtattgaagtcatgaaacttggttttggtatgcctgcctttaacaacgatgaaattatcattccctcctttatcgagaaaggtgtcttggaagaagatgcctatgactacagtgcgattggctgtgtagaaacggctgttcctggtaaatggggataccgttgtacaggtatgagctatatgaacttcccgaaagttttattgattaccatgaatgatggtatcgatcctgcatcaggcaaacggtttgcaccagcctttggtcacttcaaagatatgaaatcctttgaagtgcttgaaacggcatgggaaaagacacttcgtcatctaacacggatgagtgtcatcgttgaaaatgcaattgacattgctttagaaagagaagtaccagacattctctgctcagctctgacagatgactgtatcggtcgtggtaagcacctgaaagaaggtggagcgatttacgattacatttctggtctgcaggttggcattgccaatttatctgattctctagcagcaatcaaaaaattagtctttgaagaaggacgattgactccagaagaattatggcatgctttggaaacagactatgctggggagcgtggtaaagaaatccaggaaatgttgattgaagatgcaccaaaatatggtaacgatgatgattatgcagaccaattggtaacagcagcatatgatatttatatcaatgagattgccaaatatccaaacactcgctttggtcgtggtccgattggtggtatccgctattcaggtacatcatccatttcagccaacgttggacaggggcgtggtactttggcaactccagacggtcgcaatgcaggaacaccgttggcagaaggttgttctccatcacataatatggataaaaatggaccgacatccgttttgaaatcagttgccaaattaccaacacatgaaattgttggaggcgttctgctcaatcagaaggtcaatccacaaacacttgccaaagaagaagacaaacaaaaattaattgccctcttgcggacattctttaaccgcttgcatggctatcatattcagtacaatgttgtctctcgagaaaccttgattgatgcacaactacatcctgaaaaacaccgtgatttgattgtccgtgtagcaggttattcagcattcttcaatgtattgtcgagagcaacacaagacgacatcattggtcgtacagaacatacattgtaaaagaggttattattatggaattcatgctggacaccttaaatatagaggaaatacgaaaatgggctgaggttttaccccttgcgggggtgacctcaaacccaacgattgcgaggaaagaaggtgacattgacttttttgaacgtttgcaccttatccgtgacatcatcggtccaaatgcttcactacatgtgcaagttgtggcaaaggattatgaagggattttggcagacgctaaaaaaattcgtgaattggcaccggaaaatatctatattaaggttccggtaacgcctgctggtttggctgctatgaaaacattgaaagcgcaaggttatcagattacagcaacagcgatttataccgtttttcagggcttgttagctattgaagcgggtgcagattacttagcgccgtactacaatcgcatggccaatctgaatattgattcgaatgcggtcatcgctcagttatcagaagcgattgatagggagtgttcggaaagtaaaattttagcagcatcattcaaaaatgtggatcaagtgaaccaagcatttgcaaatggggcgcaggctattacggcaggtgcagatatatttgaagcagccttttctatgccatccattgaaaaggcggtaaatgattttgcagatgattggtctgccattcatggaaggtatactatctaaacatttctatattataaaataggggggcactatgaaacaattctcaggtctttcacgcactatccaaggaaatcatcttttagacacttgtgcgattgacattttgaaaataggtcatcgtccccttgttttatgtgcaaaacaggagtataatacaactgtagaaagttttgtgaaagttttaacttgtcatggacttattgttaaaatagcctatatggaggagtgggaccagaactcggttgaagaatatggggaagttggtttccgacatcgtgcagaccatattattggcattggtaatagttctgtggcagcttgtacaaaggctgttgcagatttactagacttgccagctgttcttataccgacttcacagtttaccactctaccttgggtatcggtggaaaataagaaaagagagcgaccattgtttaatgagtccatccagctaattatagcggatagggagcaattattgacacaacctacctcggagttgataaatggagtggtcaatactcttctttatctagcagccataaaagaagtacaaagaaatcatctattcagcttgatagatgatattcttatcagagattttgaaagcgttttattaagaagtagtcttcaagctatagagaattttgaagctcggatattatcaaaagaagtacaagatgtcttagaagttctttctacttgtgtaacattagacctgcctagtgatgcttgggacgtgattcaacaaatagaatcaaagctcagcgaaagaagagaggatttggtggatgagccattgaaacgaaatgttgtcctctacttgcttctgacctatttgacacaggaatcagaagaatttcaagccagactgaagtggagtcaacagttgcttttgtctgccaactctagcaatctattgtcgctggaggcagttttcaaggaaattgcactagagatgggagaagatggctcgacacgttgttagtaggcatcgctgtacaatggcaatatttaaaatgcaggctcatacctcttactttcggcaatgctcactgtcgtttattactcaatataacactatctattatttcaaggaggaattcttatgaaagtatttgcaagtccatctcgctatattcaaggtaaacatgtccttttccaaggtgcagaagctatcggaaaattgggaacaaagcctttgattctttgtgatgatttagtatatgggattatcggtgagaagtttttgtcctatctcgttgaagaagggatgcaagtccatcgtgttgcctttaatggagaagcatctgacaaggaaatccagcgcgtcgtagaaatcggaaaagaacaggctagtgacgtcgtaatcggtctaggtggtggcaagacgattgactcagccaaggcgattgctgatttactaggagtgccagttgtcattgctccaactattgcttcaacagatgctccgacctctgctttatctgtcatttattctgaagaaggggcgtttgaacgctatattttctataagaaaaatccagatcttgtcttggtagatacagcgattatttgtcaagcaccgccacgtcttttggcttctggtattgcggatggcttggcgacgtgggtggaagcgcgtgctattttacaaagcaatggaacaacaatggcaggaggaggtcagacacttgctggtatcgctattgcacaaacctgtgaacaaacactctttgaatacggacttcaagccatggccagctgtgaagccaaggttgtgacagctgctttagagaatattgttgaagccaataccttgctaagtggtttaggctttgaaagtgcaggtttggctgcggcgcatgcgatacacaatggattcaccgccttggagggagacattcaccatttgacacatggtgaaaaagtggcttatgggaccttgacccagctctttttggaaaaccgtcctaaagaagaattggaaaaatacatccgtttctatcaagccttgaatcttccaacaactttggaggagttacatttggctgatgctagttatgaagaactattgaaagtcggccaacaagcgacgattgaaggagaaacaattcacggtatgccatttgctatttcagcagaagacgttgcagaagctctgatggcagttgactactatgttcgctcattagataaataagaagagcattcacagttgagcatgtccatctaaactggtgaatagaggttcgaagtaattgccttgggaaattctttctcagggcttttcatttgaaaaaattatgatataattgttaaatataaaatatttagaaaattttgaagaattgacttaaaggagatttctatggcctatgtagtagctgttgttggtgccactggtgcagttggtgcccaaatgattaaaatgttggaagagtcaacacttccaatcgagaaagtgcgtttccttgcttctgcccgttcagcaggtaagaccttgcagtttaaggggcaggatattgtcattgaagaaacaacagaaacagcctttgaaggagtggatattgccctcttctcagctggtggctctacatctgccaagtacgctccttacgctgtaaaagcaggagctgtagtagttgacaatacctcttacttccgtcaaaatccagatgttcctctggttgttcctgaggtaaatgctcacgcgcttgatgcccacaatggtatcattgcttgtccaaactgctcaaccattcaaatgatggttgccttggagcctgttcgtcagaaatggggcttggagcggatcatcgtatccacctatcaggcagtctctggagcaggtatgggagctatcttggaaacacaagctcagcttcgttctgtcttgaatgatggcgtggaacccaaagcggtagaagcgaatattcttccttctggtggcgataagaagcactatccaatcgggttcaatgctattccgcaaatcgacctcttcactgaaaatgactacacatacgaagagatgaagatgacaaaagagactaagaaaatcatggaagatgacagcattgccgtttctgcaacctgcgtccgtattccagtcttgtcagctcactctgaatctgtttacattgaaactaaggaaattgcaccgattgatgaagtgaaggcagctattgcatccttcccaggggctgttttagaagacgatgtggctaatcaaatttatccgcaagccattaatgctgttggtagtcgcgatacttttgttggtcgcatccgtaaagatttggacaaggaaaacggtattcacatgtgggttgtttctgacaacttgctcaaaggcgctgcatggaactctgttcaaatcgctgaaacccttcatgagcgtggtctagttcgtccaacggcagaattgaagtttgaattgaaataattttattaaccaaaagtacacaaaaggctgcactcagccttttttagcaacaatcagtaagagaggaagcctatgtctattcaagatttacgtgatgtaaaaattattacagcaatgattacccctttcaaagaagatggttcgattaattttgaagttttacccgaattgattgaacatctgttgtcccatcacacagaagggattttattagcaggaacaactgccgaaagtccaaccctgacacacgaggaagaactggaactatttggtgctgtgcaaaaaattgtcaatggtcgtgttcccctaattgcaggtatcggtacaaatgatacgcgcgactcgattgagtttgccaaagaagtggcggcattcggcggctttgcggcaggtcttgctatcgtgccttactacaacaaaccctctcaagagggaatgtatcagcacttcaaggctattgcggatgcctctgatttgccaatcattatctacaatatcccaggtcgtgtcgtggttgaaatgacgccagaaaccatgttgcgtttggctgagcatccaaacatcatcggtgttaaagagtgtaccagccttgctaacatggcttacctaattgagcataaaccagaagacttcttgatttatacaggtgaggatggcgatgctttccatgcaatgaacttgggagcagatggtgtgatttctgttgcatctcacacgaatggtgatgagatgtatgaaatgtttacagccatcgaacaacaagatattcgaacagcagccgctattcaacgcaagttcattccgaaagtcaatgccctcttctcatatccaagtcctgcaccagttaaggcggttcttaattaccttggatttgaagttggtccactccgcttgccgttggttccatgcccagaagaagatgctaaacgcattatcaaagtcgtagtggacggcgactacgaagcgaccaaagccactgtgacaggagtcgtaagaccggattattaaaatagtcaggggagtgactattttaacgtgagccttgaaataagagagcgaacaatgtctgggggagtgaaacagttcggggaactgtttcagctggtcaccaagaaatatgaaagtgaccatagaagacccgagccaagaaatgcgaaagcgaggatagtcaggggagtgactattttaacgtgagttagggcataaagagtgaggtgtttagaaaaatattaatctagaggagcttctggccatcttcctcgttttatttaagtttacacaagcacatcagttatctggtgtgcttttcagttgcaagccttttcaattttttggtcattcttgatataatgactaaaaacgataaaaggattaagtatgaatattgttattataggcgcctcctttgctggtttaagtgcagctttagaatgtcgaaaattgtatcagaatgctcaaataacactaattgatagagaaaaagatgtggcttactttccaaataccttgaattggaaagtggcaggaaaaatttctggttgggaagaagcgaagatttctttgttcagcgaggtgcagcatgcagctatttcttgtctttttgaaacagaatgtctcgcagtttatcccgaaatgcgaaaggtaaagatacggcatcatcaagatataggtgatattatttatgaccggctaatattggctatgggagctagtcaaacatgggaatggggaacggaagaacttcaagactatctaattcgctcaaaaacgctatctcaagcacaagctagtctagagaaattgacaaatgcaaaaacagttgcagtgattggagcaggacagattggtttggaaagcttggatgcccttagccagttggatttgaatttgcatgtgtttgaggcgcaagattcactccttgcaaagtacgttgatgaggatatgattgcgccgattcgtcaagagatgaaaaaaagaggaatccaacttcatttatccgaaacagtcaatcagataacgattgatactcaggaagaacagctggtttgtcatacagtcacaggtaattatccagctgatttagtcttgccatccaccaatttgacgcccaatattcagctagtgaaagacaggctaaaagtgattgcagaagggactgtatgggtggatgagtttcttgaaacaagtcaagagaatatttttgctgtaggtgatttggtcagtctcccagtagattattttggacaggcatatcttccgatgattcatcatgcgattatgacagggaggatggctgctcgaaatttgcaaaagaggattgctcctattaagagagcccagcggattgtttctagtcatgtatttggctattatataactagccttggcttgaccgagagtgaggcgagcttgtggttggagagtaaatcgattcggattagaaggtcgtatagccagtgggaaccaactttagtagatttcaagctgattgtcgaagaaacgagtgggcgcatcataggggggcaactcgtttctactgcagattatattgaacagatggatgtactgtctctagcgatttcaaaggatttgaccgtctttgacttggtagaacattcttggctctgtcttcctggaaatactcctctggtccccttcatcgtagaggccgctcaagagtatattcggcaattttatcaggttgatggggagggtgtctatgcggattgattccttattggaaaagcgtgagctcgccatttatcagcttctcctctacttagaagataggaaagaggcgccatcgctaaaggatatttgtcactatttagaattgtcaaaattaactctttttcgctatattgtatctttcaatgaagaagcagaagtaaccgacttgggactctcttttcaactcgaagatgaaaaggtctttttgaagaaaaaggccagtttgagtcttcatcgtatcctagactatctctgtcaaaccagtaccaaatatcaaattattgtttatttatctgataaggaagaggtttctattcaacagctggctcaagaattgctgataagcgaagcgactctgaatcgccatcttgcctctttgaaccagatattggcagaatttggtattggaatcaaaagtggtcgtctaaaaggtagtgagcttcaaatacggtactttttacatcaaatgttgagtttgactactacgagagcggaattacaagaagagtttatgctagggaaaatagaggccttattgccggttttcgaacgcttctatcaatcgccgctaaatcccaagcaagcccatcgtctgttgttgtggttaatgatttcacagcaacgctctcgattgcgacagctagattttaagcacctttacaaattgatggaaccctatcaagaacataagttttaccgacgtttgagaaagatgtattttacactaagtcagcaacaatccacctctttccaagaaggggaaattatggcgttgtttgctttcctgtttagccattttattttagtgccgcatcaattagagcaggttcttggtttcggtggaccgattatggaagctacctctttggctcttcagaaattacggttatattttgagggaaatttaccagtctcagaagaagcgctctatcatttgaaccaaatcatgagccagctatatttcttttattcttccgttgaactggaagaggtagaagcttctagtttctattcagaagcagaagacttgctaaaagacgtctataaatcagtttttcatagaaaagtcgataaaaaaataaggaactcttatctgacaaatattgcggatttgtatatttattttggtcaggtccagcctatacaggtcaaggttgcttttgcttcttccctacatgaggttctatcctatcctctcttgttgcaactaagggagaagttagaaggcaatcgtcaggttcttattgagccctatcaagcaggatatgactatgatttgattattacagattacctcgaaaatacaagcattccagtttattgcctaggaaatcgattgaaaatccaagatatcgtacaattaaaggcatggatacaggatatatatcatcaaaagtcctgtcaatcagagattatggcgaccaaaacttcttttcctatcgagcatcgctagatgatgtcagatagtctttgtgaaaaatgtaagtgcatttaaccttgaaaaatttattttataaactctgataacagttgatagaatcatctttctagccactgcttatcagatttttttatttttttgaaaaaaatgataggaaaaattcacaagaatgggttagaatagaattaccaagaaaatggaagcgttttcaaaaaaagataaacaaacaggagggagacctatgtctactgaaaaatatatcatggccattgaccaaggaactacaagttcacgtgccattatcttcaataaaaaaggtgaaaaggttggcagttaccaaaaagagtttacgcaaattttccctaaaccaggttgggttgaacacaacgccaatgaaatttggaattctgttcagtctgtgattgcagggtcctttatcgaaagcggtgttcgtcctgatcagattgaaggaattggtattaccaaccagcgtgaaacaaccgttgtctgggataaggaaacaggtcttccaatctacaatgccgttgtctggcaatctcgtcaaacagctcatattgctgaccagctgaaggcggatggtcatgcagatatgattcatcaaaagacaggtctagtagtcgacgcctacttctcagcaaccaaagttcgttggattttagatcaagtccctggagcgcaggaacgtgctgaaaaaggtgagattctctttggaaccattgatacttggttggtttggaaattgactgatgggaaatgccatgtgacggattattcaaacgcagctcgtaccatgctctacaacattgaagagttgaaatgggatgatgaaattttatctcttctcaatattccaaaagccatgctgccagaagttcgttcaaactctgaagtttacggcacaacagctccattccatttctatggcgcagaagtgccaatctctggcatggcaggtgaccaacaggctgccttatttggacaattagcatttgagccaggtatggtgaaaaatacttacggaaccggttccttcatcgtgatgaatacaggtgaagagatgcagttgtcacagaacaaccttctcacaacaattggctatggtatcggtggcaaagtctattatgcgcttgaaggatctatctttatcgctggttcggcggttcaatggctccgtgacagcatgcgaatggtgactacatcacctgagtcagaagagcttgctcgtaagtctaccagcaatgatgaagtctatgttgttccagcctttacaggacttggtgctccgtattggaactcagatgcgcgtggctcagtctttggtctcactcgtggtacgactaaagaagacttcgtcaaagcaactcttcaatccattgcctaccaagttcgagatgttattgacaccatgcaattggatacaggtattgatatttctgtcttgaaggttgacggtggtgcagcaatgaacagcctcctcatgcaattccaagcagatattttgggtattgaaatcgcacgcgctcaaaaccttgaaactacagctcttggagcagcattcttagcaggtttagcagttggtttctggaaagatttggatgaattgaaagaactcaacgctgtcggccaatccttccaaccaaccatgaacgaagctcgtaaagaacaactttacaagggatggaaaaaagctgtcgcagcaactcaactatttgcagaagtggatgaagagcaataaaggacttgttagctaggggaaagaagaatttctgcttgctagacagtcctattcgaaagttaggaagtgaatcgtatggaattttcaaaagaaacaagacgcttagctattgagcgaatgcaggatcgtcaacttgacctcctcattatcgggggtggtattacaggtgcaggtgtggctttgcaggcagcagcaagcggtatggaaacagccttgattgaaatgcaggactttgcagaaggaacttccagtcgctcaaccaaattggtccacggtggtcttcgctacctcaaacaatttgacgtggaagtggtatccgataccgtatctgaacgtgctgtagtacaaaatatcgccccacatattccaaagccagacccaatgcttttaccagtctatgatgagccaggttctaccttcagcctcttccgtttgaaagtggccatggacttgtatgatctcttggctggcgtcaataataccgatatggccaataaggtcttgacaagagaagaagtacttgaacgcgaaccaaacttgaagcaagaaggattgattggtggcggtgtctatcttgatttccgcaacaatgatgctcgtttggttattgaaaatatcaaacgtgcagccaaggatggtgccttgattgccagccgtgccaaagctgagaaattcatcaaagatgatgctggaaaagttgtcggtatcgtcgctcgtgatttgctgacagaccgcacctttgaaatccgtgcgcgtttggtcatcaatacaacaggaccatggagtgatgaagtgcgtaatctgggtggagaaggttcaggcgttctccagatgcgtccgaccaagggtgtgcacctagttgtcgatagctctcgcttgtctgtaccacagccgacttactttgatactggccatgcggatggtcgaatggtctttgtccttccgcgtgaaaataaaacctattttggtacgactgatacagactatactggtgatttggcaaatccaatggtaacccaagaagatgttgactacctgcttgatattgtcaacaatcgcttcccagaagcaaacttgaccctggatgacattgagagtggttgggcaggtcttcgtcccctcttgtctggaaatggtgcttctgactacaatggtggaaacaacggtaagctcagcgatgacagctttaatagcttgattgaaacggtcaaaggttatatgaacaatgaaaagacacgtgacgatgtggaacatgatttgacccatctggaaggcagcgtttctgaaaaacacttggatccttcagctgtatcacgtggctctgcccttgaccgtgatgacaatggtttgctgactcttgctggtggtaagattactgacttccgtaagatagcggaaggtgcaattgaaaaagtggcagacattctcaaagaagaacatggtcgcagcttcaaactcatcaattctaagacctatccagtctctggtggtgaattgaaccctgcaaacgtagcagaagaaattgaacatcttgctcaactaggtgtgaagaaaggtctcctttatgatgacgccctttacttggcaaacttgtacggttcaaatgctccaaaagtctttgtattaaaccataaagtagaagccgtttctggcttgaacaagcgtgatttgctttcccttcactatgctatgaaggaagagatgaccttgactgcagttgactatcttcttcgtcgtaccaactacatgctctttatgcgtgagcagttggatgcagttgcgcttgaaatcattaaggaaatggcagcttattatgcttggtcagaggaagaagttgctcaacagaaacaattgttggcagatacacttgttaagaatgatttgacctatttgaaagaaaaatagaaagaggtgcatgatgacaaatgaattaatcggtgaagtgttgggaaccaccttacttgtcttactaggtaatggtgtggtagcaggagtagtactagataagagtaaggccaaggatgctggttggattgtaatcacaattggttggggtctagcagtagccatggcagcttttgtgagtggtttattgggaactgcccacctcaacccagctgtatcaattgcaatggcctttgcaggaaatctcccatgggcttctgtagtcccttacatccttgctcaatttatcggagcctttatcggaagtatcttggtctacctcatgtacaaagatcactacgatgcaacagaagacactggtgctgtgttggcaactttctctactggacctgccatccgcaaccttgtttctaatacaattagcgaagcaatcggaacctttgttttggtcttgggattactggctttcggtcagtatgattttccaacagggattggcactttaatcgtcggtggtttgattgtctcactcggagtttctcttggtggtccaacaggatatgccctaaaccctgcgcgtgatcttggtcctcgtatcatgcatgccatccttccattgaagcacaagggagattcggattggggctatgcatgggtaccagtagttggtccaatcatcggaggcttgcttgcggctctcctttatggtctcattttttaaaaaatatccttctctaatcagcaatggttagggaagttttttattacttggctgtcaatcgtgagcaaaagatttttatttatcaataattagtgataaaatatgtctatcaacatcagtgaggtcatcttatgaacaatacaggtattcatcacatttcaagcttggtaggaaacatacaccaagcctatcatttttatcatcatattctcggcttaaaattgaccttgaaaactgtcaatcaagaagattcaagcatgtatcatctctttttcggtgatgaagagggccgctatggaacggaatttaccatttttgatatgcctaaccatcccaatcatcgaaacggaaccaatcgtttggaaagaactgtttttctggtaaaaaattttgaggcattagaattctggcagaaaagactgacagagtttgaagtggagaatgaaggaattcaggcttttggaaatgggcatattctgaatttccaagatgaagatggccagttgcttggcttgacctatcataacgctatcggagaaatgtttccgtataaaatagatgaaattccgtcggaatacgctattcttggcattgccagtcttcacatgcgaatacgtgaagaaaaggcattactaagtttgctgacagaaaccttcggatttgttgaggaaagtcgatttgtctttgaggataagatagtgatttctcttctctttgataacaccttccaacatcgactttatttgatacttgaccaagagtcgccaatcagcgttatgggagtcggggccattcatcatatcgcatttggtgtcttagatgagtccgacttggaagacctgattagtcgcttaaatctcatcaatcgtccacattctggtatcattaatcgagatttcattcattccttgtacttccgagcgccaaattaccttatgtttgaggtggcaaccatgactggtgagcgcgaatcggaaatgccagctcagaatgaagagttggatcaggtagacctatttttgccaagtttctttgaagaggatagacaggaaatcgaaaaaaatctctcccaacgttattaggagaaatgaagtatggattatcgctttatcaaagggaccagtcccagtcttttggtctttttccacggcacaggtggcaacaaggaatccatgctctttcttcgctaacagctggatccagaagcttttgtcctttccttagatggaagttggggtcaaggcagggaaaggcgtttctttgcacctctcattgacggtcagctggatcttgtcgatgttgaaatgcgcttgtcggcttttctggatttttggcaggacttggacatccgagattatcgtcagattactttcgtaggtttttcaaacggtgctaactttatcatgggcttgttggccaagcagtcaaacctggcggacaattatatcttgctccacccttcggccttagattacgcttttcctatggaaaatagcagagcagagattttatttacactggggcagaatgaccaactcgtcgaccaagtcgctcttgaacatcttgtagatgactggcaagcgtcagcttttcccagagccaacctagttcgttttgacaagggacattttttaagtcaggatgaattgacctacgtgggaaattggtatcaagaaagaatagacaaaaagacctgaacaagttcaagtcttttatgtgtcttagattagtgtttccaatttatccaccaatgaaccaacataggcaatggtttctttgagtggttggtcagttgaaacgtcaacacctgcgtgcttagcaaggtcttgggcagaaagacttgcaccgagtgacaaggtttccaaccatttttcaacaacttcttcaggatgttcttccaattgtttcgccatagccgtaccgatggtcaaaccagctgagtaggtatatggatacaaaccaatgtagtagtgtggttgacgcatccagataagacctgcatcgtcaccgatttcaaagtcttcaccccagaattccttgatgacatccaacttgatttggcagagaatatcaccgttgaggtattcttcattgtccaaacgagtgtagacttcacgttggaaggctgcttcaagcaagtgagtgaccatgttgtggaagtaagtacggctgatcaactcgctaatcaagtaagcctggaagccagggtcttggttgtttttcaaaagggtgttacatgtcaagacttcatttgcagtagaaggcgcctcgatgaagtagagggatggatcgtagctaaggacactttgtttcttagccaattggaaatgaccagcatgtcccaattcgtgagccaataccaagacctcgttcatcaagcctgtccatgaaagtaggatgtaagatggtccatcgtaaagagtagcacagaagccaccagtagccttaccttcgttttgagcaaagtcaatccaacgctcatcaaatgattgttcaatcattttcacataatcttcaccaagaatgcccaggcagtcaatcaagaattgtttggattcttcaggtgtgatgcgttggttgtattcagatggtagactgattttcaagtcagcatgtgtgatcttgtccaatccatgagccttagcaaccaattttacatagcgacgcatgtgaggagccaattctttcatgatgacatcaatctgacggtcgaagagatcacgagagacattttgactatgcaagaggaagtcaatcgtattgtcaaatccacgcaagcgagcttcgatttgctcattcttgatatgagacaaataagttgctgcagttgtattcttgtattttttcaaggttgaatagaaaccagcagctgaattgcgacggatttcggtatcatggctgagctcataatcattttcaaagagcacatagctattgccgagcgtttcgccatttgcctcgaagttttcaaatgtcatatcttcaaacttggtcacaccgtagttgttatagggctgaccaaatgttggtgcaaaatttgataaaagttcttcttgaagtgggtgcagttgatgcggcttgtcacggagaatagcatcaaagaatgcagcccattgtggttgttcttcttttaattcaagtagaaaggcttcatctaattgaccaagttctgaatagaggaaatctcgttgaggacgtgccttggcagaaacgaggtcgtattcgttggccaggctcgccaattcagtattcatcttatcgacttccaaaggaaggaaggcatagtgggaaagtctgctatcaagaataacgattttttcgtattctgttaaggcggaaacgatggtatccttatcagttagctttcctttgtaattcgattcgaaagctgtcacttgcttagcgtaggctgccaaattttctttgtagttatcaggggtcggaaatagaatgtccgtatcccaagttaattgcacatcaatttcttgacgtttaggcattgcatttgtcatgattttctccttatttcattttaataggtccattatatcatactaaagggctttcagcgaaaataagccaaggcaaaatttatgaaaaagaatacttgacaaaatacacaaaaacctagataatgtaagtatgaaagggtttactgaaaaccagaaaggagcttttatgcaagtcattaaacgtagtggagagattgttgaatttgatccagataaaatctaccaagccatcattaaagctgcacagacagtctatgtcattgatgaaacttggcggaaaaatcttgctcaggtcacaaagaaagtagtgcttgacttggaagaagctcatacagagcgaccaacgattagcatggttcagtcgcaagttgaacatcgtcttttagatgcagggtatatttctattgctgagcattacatttcctatcgcttgcaacgtgatttagaacgtaacggctatggcgataagattattgtacatctgcgttttgaacaagtacgttaagagaaacctagagaaatctaggtttttgcttttatatatctttacattgtttaaagaaaatagcatttcaaaaactttttgaaaaaaatgtgatattctgagcatattttttgaaatcggtaacatttatattgtataatatagttcgtaaaaaaatatattttcgaaagtgagattttacattatggctaaaatcgttgttgtcggtgctaaccatgctggtactgccgcaatcaaaactatgttgacaaattatggtcaagaaaatgaaatcgttgtatttgaccaaaactcaaatatttcattcttgggttgtggtatggctttgtggatcggtgagcaaattggcggtcctgaaggacttttctactcaaacaaagaagagttggagagcttgggtgcgacagtatacatggagtcacctgttacaaacattgactatgatgccaaaacagttacagcgcttgtaaatggtcaagaacatgttgaatcatttgaaaaacttcttttcgcaactggttcacaacctatcttaccaccaatcaaaggagctgaaatcaaagaaggttcgcttgaatttgaagcaactcttgaaaacttgcaatttgttaaattgtaccaaaactcagcagatgttattgaaaaattgaaaaacaaagacatcaaccgcgtcgcagttgttggtgctggttacatcggtgttgagcttgcggaagcattccaacgtaaaggtaaagaagtagtacttattgatgttgtggatacatgtttggctgggtactatgaccgtgacttgtcagaccttatggctaaaaacttggaagagcatggtatcaaacttgccttcggcgaaactgttaaagaagttgctggtaatggtaaagttgagaaaatcatcactgacaagaacgaatacgatgttgacatggttatcttggctgttggtttccgtccaaacactgcgcttgcaggtgaaggaatcgagcgcttccgtaatggtgccttccttgtaaacaaacgtcaagaaacttctatcccaggcgtttacgctatcggtgactgtgcaacaatctacgacaacgctactggcgatacaagctacatcgctttggcttcaaatgcagtacgtactggtatcgtagcagctcacaacatctgtggcactgaccttgaaggtatcggtgtacaaggttctaacggtatctctatctacggtcttaaccttgtatcaacaggtttgacacttgaaaaagctactcgtcttggtttgaacgctgctgttactgaagtaacagacaaccaaaaaccagaattcatggagcacggcaacttccctgtcactatcaagattgtttacgataaagattcacgtcgtatccttggtgcgcaaatggctgctcgtgaagacatctcattgggtatccacctcttctcattggcaatccaagaaggtgtaacaatcgaaaaattggccttgacagacttgttcttcttgccacacttcaacaaaccatacaactacatcacagtagctgccttgggtgctgaataattaattgaatacaaaagctcagagatgactctgggctttttttgcttgccatctatcacattgaactgtctatcgagagattttttggtataatggagagaatgattataacgaacctgtattcacagtgtagtacttccatctaagcctagtttttcagctattcatcgtttgtttttcaaaaaatacagtcggtattccttcaaaaaactgccttgattagcgaaaaactatctcttatttaaaagcactccacttgtaatacatgttctaagaaagtatgagaaaatgaacccattattaaacggaatgaatgacagacaggcagaagcggtacagacgacggaaggtccgcttttgattatggcaggggctggttcgggtaagacgcgagtcctgacccaccgtatcgcttatttgattgatgaaaaaatggtcaatccttggaatatcctagccattacctttaccaacaaggcggcacgggagatgaaggagcgggcctatgccctcaatcctgccacgcaagcctgtttgatagctaccttccactccatgtgtgtgcggattttgcgtcgggatgctgaccatatcggttacaatcgcaattttacgattgtcgatccaggtgagcaacgcagtctcatgaaacggattttaaaaaatctcaatctagatccgaaaaagtggagtgaacgttctatcctgggcaccatttccaatgccaaaaacgacttgattgatgacaaggcatttgaagcgcaggcaggcgacctatacacgcagattgttgctaaatgctacacggcttatcaaaaggaactaagacagtcagaggccgttgactttgatgatttgattatgttgacgctccgcctttttgaccaaaatccagaggtcctgacctattaccagcagaaattccagtatatccatgtcgatgagtatcaggataccaaccatgcccagtaccaattagtcaagctcctggcatcacgtttcaagaatatctgcgtggtcggagatgcggaccagtctatctatggttggcgtggtgcggatatgcaaaatatcctggactttgaaaaggactatccagagagcaaggttgtgcttttggaggaaaactatcgttcgaccaagaacgtcttgcaggctgccaatgaggtcatcgaaaacaaccgcaatcgacgtcccaaaaaactctggacacagaatgcccaaggggatttgattacttactatcgtgccagagatgagaatgacgaggcgatttttgtcgcagggcagattgaccagttgcaccgagaaggcaaggcttataaggattttacagttctctaccgtaccaatgcccaatcacgtaccattgaagaagccctgctcaaatctaatatcccttataccatggttggaggaaccaagttctacagccgtaaggaaatccgggatgtgatttcttatttgaatatcattgcaaatccatcggataatatctcctatgaacgcattgtcaatgagcccaaacgtggcgttggacctggtacggttgacaaactccgtgattttgcgaccagccacagtatgtccttgctagaagcttctcaggatattatgttgtcaccagtcaagggcaaggcagcgcaggcagtctttgacctagccaatctcctctataatcttcgcaatcaattagacaacttgacggttacccaagtagtcgaggcagtattgaaccaaacaggctacatcgatgcccttgcagcacaaaataccctggaagcaaatgcccgcattgaaaacatccaggaattcctttctgttaccaaaaactttgatgaaaaggatgttgaggaagaagagacaggtctagataaattaacacgcttcctgcttgatttggccctgattgctgacacagatgatggcgatacagaatcttcagaagtgactcttatgaccctccacgcagccaaaggtctggaatttccagttgtcttcttgattggtatggaggaaaatgtcttcccacttagtcgtgcagcagaagaagaggacgaattggaggaagaacgtcgtttggcatacgtaggcatcacccgtgctgagcagactctctacctgaccaatgccaattctcgactccttttcggtcgcaccaactacaaccaaccaagccgctttattcgagaaatttccagtgacttgcttgattatcaaggcctcgctcgtccagctaatactagctttaaggcttcttatgtcaatggcagagcgacacagtttggacaaggcatgagcttgcaacaagccctacaaagtcgaaaagcatccgtacaaccatctgccaagctcggaggtagtatgcccttcgcatcaagcaaccaatcgtcaagctcaggcaccaactggtcagttggtgacatcgcagtccataagaaatggggccgcggaacagtccttgaagtatcaggttcaggcagcaatcaagaactcaaaatcaatttccctgatatgggactcaaaaaagtcttggcaagcttagcgccgataagtaaagaagattaaatttagttaaaaaataattgcagtaagctcgaaaatatgataaagtatttttgtaaaattgaatagaacatttggggtgccaagaggctgagattatacccatcgaacctgatgcagttaggactgccgaagggaaatgtgtatcaacaaattttgttgacaagtactatatttgtattctagtatagaatactgtatttactggtcatcaatcatcgtaggtgtaactccatttgataaaccatcagatggagttttttctattgtcgaatgaagagttctcagaaatacggaattgagtgcaggtagctcgaccagcctagaggctatactacgatggaaataagatatgcgcaataagtcactttcgtagagttcgacaaggcgaaactgatgataaggctaatacaattaatagtattttcacaaatccccttagccccttcaatttacattttcaccgagaaaaagagaaaggagatatagatgaacaaaatggtcatttggtttgaccttgatggcgttatctttgattcctatggggtctgggatcaggtggttcaaggaattttgaaacatcacggggttgcttatacccagcagataagggaagaactttggcgtattccaatggaagatgtcaacgggtatttattgcaacttgtggagaattccttagatgagaatgaacttgaaaggcaaaaaatgaatcaactgcaatcactatatagagatatttccttgatggatggtgtgcatgaactcctatctacattgaaggcaaaaggtgcagtcatgtacgcagtcacttcaaactatctggagctggctgaactaggattgtcatcccatcatctttcaaactattttgtgaaactatttagcagtttgaatctgtttggaagcgataaaaatagggagttttaccaattcatcctacatcaggaacggatagatccagccaatatcgtaatggtcgaggataataagaacaatctttgtattggacatgagttaggaatagcgggagtttatatagaacatccaaattcccctttttctgatgagaatacaggtatagttagcatcaagcaattaagtgaattaataccaattttggaggatagaaaatgacatctttacatgtagcattatcaatagcaggaacagatccaacaggcggagcaggcattatggctgatttgaagagctttcaggctagatcagtttatggtatggcagtcgtgacgagtgtcgttgctcaaaataccaaaggggtgcaactaattcgtcatcttgatcaggaaattttagaagaacaattgaaaagtgtctttcaggacattgttccagatgcaataaaaactggaatgttagcacaagtcgagaccattgagcttgtcgcaagctatcttgcaaaacagaagtgtccatatgtcttggatcctgttatggtcgcaacgagtggagaccgtttgattgaagaggatgcaatcaaagcgctgaaaacaaaattactgccccttgctaccatcattacaccgaatctaccggaagcagaagttctagtcggtagaacactgaaaagtgaaaatgacatcatgaatgcgggccgttggattcggaaagaacttggggtaaaaaatgtggtcattaagggtggacatctggcaaaggcggcatctgactacttatttttagaagatggtgagattagtgtcatcagtgcagcacgcatttctacgaaccatacccatggtacaggttgtacctacgcggcagtcattactgcagagttggcgaaaggtcggacagtagcaaaagcagtcgaaactgccaaacgatttattacagaagcaattcagactgctctagaactggggcatggaaatggtcctgtcaatcataccacctacagaggagagtaactagatgtatttggaaaaattacgtagtcaaaatcccttgaccatttgtattacgaatgatgtagtcaaaaattttacagctaatggcttacttgctctcggtgcctcacctgcaatgagcgagtatccagaagatttggaggatctacttccctatacaaaggggttattgattaatacaggaaccttgaccaatgaaacttgggaactatacaaatctgccttggatattgctgagaaatatggtgtacctactgtcttagatcctgttgcggcaggtgctggtgcctatcgcaagaaagttaccttggatctgttacatcatcatactatttcactcgttcgtgggaatgcaggagaaattgcagccttgattggtgaaagtattgaaacgaaaggggtagattctgctcagattgacaatgtaggtgaacttgctctcagagccaaccaacaattaggaattcctgttgtgattacaggaaaaaaagatgctgtcgctgtgaatcatcaggttcggattttggaaaatggtagtgagttaatgccactagtgacagggacaggatgcctgctgggagcagttctggctgcctttattcacctggctgatgaggattcattattggattgtttggaagaggtcctatcggcttattcgatcgctggagaaatggcagagcagaaaacctcactaccaggaaccttccagattgagtttataaatagcctctatgcaatccaatcagaagaggttgaagaaaataaaaaggtcattcattatgaatagaaaaatgcttcaagtttactttatttgtggcacgtcagattgtccaaaaggcaaatttttggatgtactggaaaaggcattgcaggcaggaatcacttgttttcaatttcgtgaaaaaggtgagcaaggtttaacaggggctgataaactactgttggcaaaacaagttcaacacctgtgtcaccgctatcaggttccattaatcattaatgatgatgttgagttagcacgtgccattgatgctgatggaatacaccttggacaggaagatttgtcagtagtagaagcgagacagctcttcccagggaaaataattggactatcagttggaacaaaagaagaatacctcaattcgcctattgatctagttgattatatcggaagcggacctgtttttcctactctatctaaggatgatgctagcccagccattggaatggatggattaaagcaattaaggaaactcaattccgatattcccatggttgcgataggagggttatctgctaaagattgtaaggaagttctccaagcaggtgcagatggcatagctgttatctcagccatttcccatgctgaagacccctacaaagcaaccaagatattggtggatgggatgcaagcaatgattttaaaatttaatcaagtagaatctaataaacaaatactaaaaaatccctaatcaatttgggtcttttcatttgatattaaaacgaattcttagttgatattagtggcaagaaaaatagtttttctactttacaaaaatcaaaagccttaaaaatagcgcaattttattatgttatataaataagtgttaaatatttcagaaaatctgactacttcacaaaaaattaaatcatcttttgtaatggaatccgcatttagcaatacaaacattcatcattcgaaatgagtagaagttaagtaatacaaattagagtttaaaagctcttggaattaggaagattttatcaaaatttatttataaagtatggcttagaaatctggaacaaatcgtaaaacaagaagacatttgtccttaaaatgtttgtgtattatgacattggatatgtttttttgctattgaatcggacggaattcctttacttgcaaaaaagaaagcgttatcattgttgtggtaacaataaagaaaggagcgtgtatgattttgaaaatgcatctactattggatataatcgagatgaatccagatgtatattcattactaaagctttgcccatatgaaatcttgcgtaaaatacatgtcaagagattcgaagatggtgaatttgagttggagcaaggggagatctatcagtatatgtatattattgttgaggggagggtcaatgtttactcggaatcggaaaatgggaaaaaatattttctttgttgtagtcagtctggtgacttgattggagaaatggaaatatttcaacaagttccgtatattagttatgtgaaaggagttggtgatattatcgctttggaaatagataaagatacacttttgagttggatggcattagatcaaaactttagtagtttgtttattaagaagatttgtgaaaattcctatcgtatgtgtaatcgtatgaagcgcaatagtctatatgatcttagacagcgacttgcatactatttgctggagcaatttggaggaaaaaaattagcatcattacagtttaattcggaaagattgagtcaagagatggcggttacccaacggagtatcaatcgattgttaaaagaatttaaagaaaagcaaatcatcgatttaggtcatggtaagattcaactattggaccaccaagctttaacgagtttactagattaggagaaagaaagatggtactacaaccacatattcgttgtgacatagaacaaggtgcaagatacgccatattgccgggcgatccacagagggtggacagagtagcagagtttttagatagtgtagaatttatagcattcaatcgtgaacacaaaacaatgcgtggaagctataagggggttccagtgttagttacctctacagggatggggggtgcttcaacaggaatcgcggtagaagagttggcacgtatcggtgtggaatgtatgattcggattggctcatgtggagcattgcaaccggagatgcagatgggagatttggtcattttgaatggggctgtacgtgatgaggggacttctagggcgtatgttgatccaatttttccggcggttccagaccctgatgttttatttgccttacgaggaactgctatgaaccaaggttttgcccatcacgttggaattgctagaagccatgatagtttttatattgataatgagttggaagttgatcatttttggtctaaaaaaggtgtattagctggagacatggaaagtgcagctttatttactattggtagcctacgtgggattaaaacgggctccattttaaatacagtggcactatatgatggtgaattgaaagatgagatcaaccaatatgtgtctggcgaaaatcgtgtgacacaaggtgaaaaaaatgaaattcttacgacattggaagcgattgtgatgctagaagaacaaaggaaaggatagaatcatgaattggagaaataataatccattatcattgaagtttaatactgcagctttagtgttgattccggcaggggttgggattaattatattggtaaattgattgcgggggttctcaaattaccactttggttagattcgattggaacttgtttatcggcttgtttggctggtccaattgtaggtgctgttgtgggaattatgaataatttaatttatggattaacggtggatccgatttctacagtttatgccttaaccaatgcagccctaggaattgcagtcggtttattggcttattacggtagtatgaagaacatcaggggtgccttatttacaggaattgttgctggatttgcagcagtcttggtatcaacgccattgaatatgatcttttggggtggtacaaccggaaatttatggggagacttggtttatgcaggtctattagctcaaaaattcccagtttggtttgcatcgtttatggatgaaatagtggtagatattccagataaaatagtcgtattattacttgtgctaagcttgtataagagtttaccaaagagtctactatcgctttaccaaagtaatagtgtgattaagaacctagattaaggaggtctccatgaaaacgatgagtttgtttgaagacaagaattcatttttgaataatttgtctccgttaactaagatgttgtatgtgcttgcgaccattctgataccgattattgcaggtgatttagctgtatttagcattacaattcttttaagtgtcgttttgttagcacattctaaagtgttaaggcagaccttacccattctgagtgtatctgggtttgttattttaacggtaggaattattcaaggattgtttagaagtggtaatgtcacgcctgtttttcaattaggtccagtcattttttataaggaaggcttgatatttgcagctgagattgctttaaatgtatgtaatattattttagctttctgtgttctgattttaacgacaaaatcgtcggacatgattgaagaattagttagaaaaggcttctcacctcgaatgggatatgtgtttgtctccttgttccaattaatccctcagatgacgagccgaatggcaacaattacggatgcacaaagaagtcgtgggatggaaacagaaggttcgatgttggttcggctaaaagcttttttgccattggtctctcctgtaattatgagttcttttattgatacgagagaacgcgcaattgccttagaggttcgaggatttaattcaaaatctaaaaagacatttatcaatccaccgattcgttcgcaatttgatcgattgattcaaattttctgcatttttggagttgtgctagcaattgtctggagggttctataatggcacatattaaaattgaaaatctaaaataccaatatccctttgctgaaaagttggctctagacggcatcacgtgtgagattcgtccaggtgaattcattggggtaattggtcgaaatggttctggaaaatcgacattctgtcaatcattaacaggacttgttccgaatttttaccgtggttcgtatggaggaaaggtatggattgatcaatccgaagtgaagagggtagaggttgatgacttgtgccaaaaagtcggaagcgtttttcaaaatccatttaatcaaattacaggttctaaggcgactgtgtatgaagaaattgctttcggtttggagaatttcggagtcccaaaagaagaaatggaagttcgaattgaggaaagtttacgtttgttggacattgaagagtaccgtgatcgagctccgtttgacttgtcaggaggacaaatgcaacgaatggcaattgctagcattatggcgatgaaaccagaggtcattattttagatgagccaacttctcaactcgatccacaaggtagtgaggcagttttcaaagctattcagtctttaagtaagcaaggcatcactgtaattatggtggaacataaggttgaaaaaatcgcagcttacagtgaccgggtaatgttgcttgatcagggaaaactaattgccatggatacaccacaagccgtgttttctcgaccagatctagaaaagtatggagttgtagcacctacctttactagaatatgcaagcagttaggcatgaagctaccaggaagttcctattatcctgtgacacttgaggaagctagtcagttgttggcaaagaatagggggggaaatgtatgaatcaaattagtattagtaacttagaattttcctatcatccggataaaaaaatattaaaagggttgaatattattttagatgagcgttcgacggcgattattggacaaaatggtgctggaaagactacatttgtaaagttactgaaaggccttattcgtccgacggctggtaaaattatgttaaatggacaagatttaagcgaacaatctgtcgctaaaattgctaaaagtattggactcatttttcaaaatccagatgaccaaatttttaaacatacggtattagatgaaattatgtttggaccattgcaaatgggcatgactcattctcaagcagaacaggcagctagaaaaactatgtccttgctgggcttagatggatttgacaaggtaaatccctacgacttaggattatccgatagaaaaatggtgtcaatcgctgcaatagttgctatggatacacaggttgtgatttttgatgaaccaacgattgctcaagatgatgcaggaaaaaaacagattcaatcggtgatacaattgttgagagaacaaggaaaaatagttatttccattttgcatgatatggacttcgtagcagaaacgtttgaacgtgcccttgtctttgcacaaggagaagttttgttagatggaagtgttcgagaggttttttcacagaaagatgtccttgaaaaagcctatctatctcagccaaccacgatgcaattatgtcaagcactaggctatgatgacgtttttctcactcccgaagagttcatagcttacaaacaggagtgatgtacttaaattacaatctaggagattcctggtaaccgcttggtttttataatgttattctatactgcttcctaattattgaacgatattagtctaattctaagtttgtgagagattgcagattgaggtagttctgtttctattcttttaatctttttgaagcggacgaggttctcctttctgtatcactataaatttgtaaattaaaaatttgaatcagaaaattttataattttacaaatgtatatatttttccatttaatttagaagacttgatttgtggatagagggtaaatatttcacattgaaactttgatggaaaattatagcctttgtattttttagtatgatataattattactataaagatctagttgaattcaaaaactttatcaataagatgtctatacttgaatacttagttgtgctatctatcaagataatacacactgatataagggctatctgccgataaaatacagaaagccaagatatatctgaggctaagcggtttaaaaaggagcggttcttaaaaatgaattttacgatgatcactatagattagaaacgaattgatttcactcaaatagagggtgtttttagagaggaaaatcccaaaattgcactacaaacatttattattcgatcttgaccatactcttcttgattttagccgtggagaagaagtagccttaacccagtttttgacagctatggaggttgaagatattcaagcttttaaagaagtttatcgaccgctcaaccagagcatgtggaaggatttggaaaaagggaacattacaaagaaagagctaataaacacccgcttttcacggacctttgcccactttggtcggcaagttgatggaagggagatggccttgcgctaccaagagtttattgggcggcagggacaaatttttacaggtgcagataagcttttgcaggaattgacacaccgaggctaccagatttatgcagcgaccaacggcgtgacctatatacaggaaaatcgcttgcttcactcaccgattcaatcgtattttaaagaagtatttatttctgagcagatggggacgcaaaagcctgcgactgatttttatgaaaaaatagcagagcagattgcaggttttcaatttgcccaagccttaatgattggagacagtttgacagcagatattcaaggcggaaataatgctggtatggatactgtttggtataatccgactcacatgataaataatagtaaggcagttccaacctataccattcatagctatcaagaattattagatttgttataagatattttaagaaacttataaggattttagtatataattatacagaaagaatatatacaaaaatataaggaggaaaaagtgaaaagattactgagacgcattcgtccaacaaagcccctaaaagaactcacttggatagatttgattattatcacaacgattttatgtggtaatgctatttatacctcaaccatgcaatggatagcatcattttctgcaacagaaaccgttgaaacaggagttctgtcgtttagtccagccgataattggtgggctctagccaatcaaggaaaattattcctgtttgccctggtgtatttattgattcggaattatgatttcaagcagctaaaagtaaaattagaatggaccgttctactctggggaccactgattttcattggtgcgggcctgattagcgatttgacatttacagctttttcatatattccaggtctgtctggtgggtataatttcctcggatacttgccttactatgactggaatatcatgacagtgctcaaccgtttcctagccgttgactacagcacagttatctattccttgtttaatggcttctatgaagagttctttttcttaggattattgttgagcacagataagaaaaagcgttcgctggtcttactcttttcaacaattgtccgtatatctttccatacctatcaaggaatggtatctgctcttgttattggtgtagccttcggccttttctattactacatgtacacaaggaaaaatgacaatttattgccatatttcttaggacatgctcttgcggatatggttggtacaagtttcttctcattatttattgcagggtaaacaatgagaagaacggacatcaagctaatcggataaaatttctttctccctacagctgacaaacggatgatgatacgtagtttctattaacttggtatcatcacccgttttattgtgctgatatatttaatctattcagtcaaatttcgattgctttatcatattttttatcccatatttttttgaattaacggtttatttatgttaaaatgtatttttatacatcaaaaaggagtatagatatgaaacaaataaagaatcgtttaaaaaaacatatgttttggattggactcatttcgttggtattgatgctcgttgataatgtcctattttgttattttaatattgaatgtagtcgtaccttaaaccaaatcgagcagacgatttgtatcatccttagcattcttgtatttttaggagtgctaaataataaaccggatgtgaaggtagaagacatcatgaaaaacggtatgtcatctaaaaatcaaaaataatgtttgtttagaaactactgatgaggtatctagttgtacttacagttcagtatctctagctaagatggatttttcaaaatatagtcagtatctcctaaaaaactattttgtatataaatcactttacttgtgaatacgactatttaacatcatatatgtccaccagtcgaaaggctggtgtttctatttatgacatgtatgttatcaggaatgccactatttgaaaggaaaagaatcgagagaaattcaatgaatactaaaaatatcaatagtagttaaaatcataagccgtcattagacggggtcttatgattgtgctacaatagacataattataagagaacggggtgatgataatgaaacgtactattctattatgcttgccgacaatactgttactagcagcatgtcatcaaaatataaatcaggccaatactacaaaaaattcgtcaacagttgtttcgactacttcaagtcagtctgcttcaacaacttcggagcagtcaacaagcagctctacatcggcggaaacgaatcaagaagtaacaagtacagagactcaggtaaattttaacggttcctattatagtgtacaaggaaaatatggcgaagtgattattgtaaataaaaagcatccgcttgcagctgattatgcaccgggcgaaaatcctgaagccttagcagcttttcaacgattaatagcagatatgcaggcgctaggatttggtatctccaataactatagtggatttcgttcctatgaaactcagtcaagtctctaccagtcttatgtaaatcaggaaggacaagcagcggcagataggtattctgcaagagctggatatagtgaacatcagacaggattagcctttgatttattggatacaagtggtaatttattagaagagcctaatgcttctcagtggttggctacgaatgcacatctatatggctttgttgtccgctatcttccaggaaaagagtctagcacaggctatatggcagaatcctggcatgtgcgatatattggtcaagaagcgacagatatttacaattcaggcttgaccttggaagaatattttggtgtaccaggtggagactactaattttacatttagtcagaaataagtcgaaaaatttgtccgtataactaactcgtgatataataaaccatcataattttggaggtccatcatgcttaaagcaatggaagtatacttggttactaatggtaatggtttggaagccatcgagttttataaaaatgctcttggggcaacagtggagcaagtaaatctatttaaagatttcttaccagactgccctgctgaactagaaaattacgtaatgaatgcacagtttcgtttgaatggtcagcgttttatgttgtcagacaacaacccagaaatgccttatacagtaggtgacaatattacagttgcgcttatcacagacgatgctgagacagcgcaggaactatacagcaagttatccgtagatgcaactgctatcaatatggaacttcaagcagttccttggtctcctgcctatggtaatgtaacagacaagtttggtatctcttggcaaatcaatgctgaagtagaaggctacggtcaggaatattacgcagaaaactaaaatagattggacaaggccttgtccaatctattttagtttttgccaataagctttgtagatataaagttgaagagcagcagatagaacaaatagtaaggtcatcaaggctgagcttacataagctgcaccaatagtgccagctaatatgatgctgacaactagaataatggctccgagaaacattgttcctatgatcgatccagcaatcaaccattgacccgctccgcgaccaaataactggttactattttgccagttgagcatgaggagtcgctggtcacgccagtaataaatctgaccagttagcagggctgaaatgatgatgccgactgtaaagaagactgctagaatgagtttgactttcatgaaacctagagccaaagcaaagtaaagtagagttggtagtgcgaattgtaccgcagccaatacccagaatttttggatgataaattttttgaaactaataggaagcgttcgaatgaaatgataattttccttttccaatgacatggctactccgatgaaggttgtagaaccagcaaatagactgccaagcaagaatccagctaatagagcaataccaaagaaatcccattcaactgaacttagaccaccattctccgtgaaacggctaaaacttggaaaaagtgccacccccatgatgataggctgtatcatggtttggaccatgaggttgctatctttaagagtagataggtggtgtttcactaaagcctgattgagattgctaggaatcttggcagacttagcattattggtccgttttgtcgaagcattttcaatcgccaaaacttgattaaagtagttgggaatgacagttttaaacgcaaacgtaataagtccaaacatcaaaatgaaaggaagtccaaaatgaaggagtgtttctagtgatatagtatggctgaccaagtaatggaatccagcaaatataggtatgataggaaaatcaacaaagccaccggattcgagtgaaacggtctgctgggattgcaggaacatgagcgcagcaaaagccagcaaggaagaacctgtcatcaggattgtagaaatcaatgttttacgagggctttttgtcagaacttccccaacaaagtgcatgataatcagattgactaaattaactaaaatccagagaatcaaaaaggaaggaatggaagctaaggcgaggagcggaccgccaatttgccagtaagtgattagaagtaaagacagacacggcatgaggaagggtaggaccatcccttgtgcagagaggattttagcgaggaagacttcttgtggcttcaggggaagtgctaaatacaattttgtatccttactatcgtagaaaacggagaagaaacctgtaaaaccgtagacaatggcaataatggtaaagagcgctagttgcagagaaaagaaaccgatagactgactataatctactcccatgaaaaagacagagtagagaagtccgaaactcaaaaccataaatacttgttgcaagaggacacttttataggctgaaaaggaggcgtctttgcgcttactttgtttcttcttgacggaagctagaagttgagggttggaataaagaatattaatctttactagttcccaaatgatggatttactcatacttcctcacctgccttcacttgttggcgtccagctaattccaaatagatggtctccaaatctttatctggatactgtgatttgagttcatcaagacttcctacgaaaatgagttgcccttttcggagaatagcaatgcggtcacagagttgttcagccactgaaaggacgtgtgtagaaaatagaacggtgtgaccagattgagcatgttctttcatcatttgttttaggtcgaaagaggcctgaggatccagtccagttaggggttcatccaaaatccaaatatcagggttagggatcaatgcaccaataataatggttttctgacgcataccatgtgaaaaactgtcaataggctcatgttggcgcgctgtcatatcaaatagactagatagtttagcgatacggtcatcaactgtatccttttctacaccatagaccttgcccataaagtgccagtattcaaatgctgttaagtgtaggaagatgtctggcgaatctggaacataggctatccgttttttgacttcatcgcggttctcctctaggtttaaaccatcaacagagatagttccataactggcttcgattatcgaagtcagtagactgattgtcgttgtttttcctgccccattgtgaccaattaaaccgaaaatctcgccgctttcaattgtcaaatttaggtcatcaagtgcgattgtttcgccgtatgtttttgtgatatggtcaaattgtatcatagtaacctccttgttattcgtgaactaaaagtaggggcttgctaggtattccaagccttattccactgttcttcgaataatatatacaattaattacatttattatactgctgaattagtacaaaagcaatagtttctatcaatatttttgtagtatggatgcggatatattgcaagaagtcgagtgtaaaatggaatgcaataagctcgattatcagaaaatttgctataatagatctatgaacgatttgatcaagcataaattggagttactaccagatagccctggctgttacctccataaaaacaagtacggtaagattatctatgtgggcaaggccaaaaacctacgcaatcgggtgcggtcttattttcgtggtgcccatgataccaagacagaggctctagtggctgaaattgccgattttgaatttatcgtgacggattccaacatcgaggccctcttgctagaaatcaatctgattcaggaaaacaagccacgctataacatcatgctcaaggatgacaagtcttatcccttcatcaagattaccaaggaacgtcatccacggctgctcattactcggcagattaagaaggatggtggtcagtattttggtccctatccagatgtgggtgcggccaaccagaccctcaaactattggagcgcctctatcctttccgcaagtgtaaattgcctgagaacaagtattgtctttattatcatttggggcaatgtttggctcatggagacaatatgcccagcctgtctgactatgacaagatggccaaggaagtggcccagttcttgacaggtcatgatgataagattatcaaggaagtgcaggacaagatgaaggcagctgctggcaatttggaatttgaaaaggctgcggaataccgggatgtcctccaatccatttcaaccctgcggaccaagcaacgtgtgatggctcatgacttgcagaatcgagatgtctttggctactacgtagacaagggctggatgtgtgtgcaggttttctttgttcggcaggggaaactgattgagcggaatgtcaatctttttccatactataatgatgcgggcgaagactttttgacctacatcggtcagttttacagggaccagcaacatttgattccctcagaggtcttgataccgcaggatattgaccaagaagccgtagaagctctggtagataccaaggtcatcaagccccagcgtggcgagaagaagcaactcatcaatctggcaaccaagaatgcgcgtgtcagtctggagcagaagtttaatcttttggagaaaaatctggagaagacctacggtgcggtggagaatatcggtcagcttttggggattccgacgcctgtgcggattgaggctttcgataactccaatattatggggactagtcctgtgtcggctatggttgtctttgaaaatggggtgcctaataaaaaagaataccgcaagtacaagattaatacggttgagggaccggatgactatgcttccatgcgggaagttttgcagcggcggtacagtcgggtgctgcgggacggtttgacaccgcctgatttgattatcattgacggtggtcaggggcaggtcaatgtcgccaagcaggtcatcgagcaggagttgggtatgtccattcccattgcaggtttgcagaagaatgacaagcaccagacacacgaattgctctttggtaatccgctggaagtagttgagttgcctcgcaattcacaggaatttttcctcctgcatcggattcaagatgaggttcaccgctttgctattgagtttcatcgtcaggttcggtcaaaaaattccttctcatccaaattggacggcatagaaggcttgggaccaaaacgcaagcagactttgatgaagcatttcaagtctattggcaatatccagtcggccagtctacaagaaatcgcagaagcaggagtgccgtataaagtagcggaaaaggtcaaggaaagcctttcttcaaaggatgagatttgaaaacattcccataatgtgttagaataaactatcaatgactaaataaggagaaagtaatggcttttggtgaagaaaaacacaaaaaaacaacatttgagaaagtgactttagtaatcgttgtcgtgatggttgtagcgacattggctggcttgattttaccagctattaatgcattgatgaattaagaacctgtattcactgttcagcacttctatactaaggctagtttttaagcactcatcgttagtttttttcaaaatacagtcagtattttgaaaaaaccaccttgattggctaaaaacgatttcttatatataagcacttcgcttgtgaatacaggtctaaaacgcttttaagcgtttttttctaggaaagaatagggtaaattatgagtatgtttttagatactgccaagattaaggtcaaggcagggaaaggtggcgacgggatggtcgccttccgccgtgaaaagtatgtacctaatggcggtccttggggcggtgatggtggtcatggtggaaatgttgtcttcgttgtagatgaaggcttgcggaccttgatggacttccgttacaatcgtcgctttaaggctgatgatggtgaaaaagggatgaccaaaggtatgcacggtcgaggagcggaagatttaattgttcgtgtaccgcagggaacaactgtgcgtgacgctgatacaggtaaaatcattacagacctggttgagaatgggcaggaatttgtcattgcccacggtggtcgtggtggtcgtggaaatattcgttttgcgacacctaagaatccagcgcctgagatttctgaaaatggagaaccaggtgaggagcgcaatcttgaattagaattgaaagtgttggctgatgtaggccttgtaggtttcccatcagttggaaaatcaacgcttctcagtgttattacagcagctaaacctaaaattggtgcctaccattttacaaccattgtgccaaatttgggaatggttcggaccaagtctggtgagtcatttgcagtggctgatttgcctggcttgattgaaggtgctagtcaaggtgttggattgggaacgcaattcctacgtcatattgagcggacacgtgttatcttgcatgttttggatatgtcagcaagtgaaggtcgtgatccttacgaggactatgtagccatcaacaatgaattggaaacctataatcttcgtttaatggagcgccctcaaattattgttgccaacaagatggacatgccagaggcagaagaacatttggaagagttcaagaaaaaattggcaaccaactatgatgagtttgaagaattgccacagattttcccaatttctggtattgctcaccaaggtctggaaaatctactagaagctacagctgagttgcttgagaaaacgccagaattcttgctctacgacgaatcagatttccaagaagaagaggcttactatggctttaacccagatgaaccagaatttgcaatcagtcgtgcagacgatgcaagttggattctatctggtgacaagctggaaaagctcttcaccatgaccaacttcgatcgcgacgaatctgtcatgaaatttgctcgtcagttacgtggaatgggtgtcgatgaagccctccgtgcgcgtggtgccaaagacggcgacatcgtccgtattggcaagttcgaatttgagttcgttgattaacgtagcagtttgactgcaagttaacttgctagttaaactacgccaagtcctatgggatcttggctagctaccttactaacttcacccaaatggtggtatcaaccatttgggttccgtgtcgtaactttggaatcacatcaaaatcctaaaggacttgatgtgatacggtagccgctatggcggactacctaccaaccttactaattccgcacaggcagtggtatcgactgcctgtactccatatcgtaacctgtccggtaagttagtctagtatgaacttagaaattcgagagcagactatagctttacaaatttcgttcagttggtgacagtcgtttgtgagcaatcttaaaaaaaatagttggaggtctgtatgggtgataagccaatatccttcaaggataagtatggaaattttgtctcagcagccgatgtttggaatgctgaaaaattagaagaactctttaacaggctcaatcccaatcgcaaactccgtttggaacgtgagcgtttggcaagagagcaagaaaaggaataacgtcaaaatctgcttgttgtatcagaaaacaggcagatttttttaaaatttattgactatttattattggttatatgtataagaatacaagatatggagctaatatttttgcggtgtcggtaattttatagaaattctcaaaagtgaaatttcttaaaaaatatgtaaaaactatgaatatactggtttcttcttgaattgaagcgaattcataatgtttttttgaggaattttataatattacttggcatttaaagttatttgtagtataatacctcgaatgattgcgggagttttcaaggctttgatacaaagagtagaaaatttgtgtaattaaattaatatttatatgggggattttttatgcgtagatcaaataaaaaatcatttgactggtacggtacgaaacaacaattttcgattcgtaagtatcattttggggcagcaagcgttttgcttggtgtgtcgttagttttaggtgctggtgcacaggttgttaaggctgatgaaactgttgcttcatcagaaccaactattgccagtagtgtagcgcctgcttcaacagaagcggttgcagaagaagcagaaaaaacaaatgctgaaaatacgagtgcagtagctacgacttcaacagaagttgaaaaagcgaaagctgttcttgaacaggtaacatcagaatcaccacttttggctggtcttggtcaaaaagagttggctaaaactgaagatgcaactcttgcaaaagctatagaggatgctcaaacaaaacttgcagcagctaaggcaattttggctgactcagaagcaactgttgagcaagttgaagcgcaagtcgcagcggttaaagtagccaacgaggcgctagggaatgaattgcaaaaatacactgtagatggtctcttgacagcggctcttgatacagtagcacctgatacaactgcatcaacattgaaagttggtgatggcgaaggtacccttctagatagcactacaacagcaacgccttcaatggctgagccaaatggtgcagcaattgctccacatacacttcgaactcaagatggaattaaagcgacatcagagccaaattggtatacttttgaatcgtacgatttgtactcatataataaaaatatggctagctcaacttataaaggagctgaagttgatgcctacattcgttactctttggataatgattcgtcaacaactgctgttttagcagagttggtaagtaggacaactggtgatgtgttagagaaatatacgattgaaccgggcgagagtgttacgttttcacatccgacaaaagttaatgctaataatagcaatataactgtgacttatgatacctcattagcttctgctaatactcctggagcattgaaattctctgctaatgatgatgtttattcaacaattattgtacctgcttatcagattaatacaactcgttacgtcactgaaagtggcaaagttttggcaacctatggtcttcaaactattgcaggacaggtagttactccatcttctgttcgtgtatttactgggtatgattatgtggcaactacaactaaagccgttcaaggtccatatccaaagggaacggtataccttgctggtacggttcaaaaggatacagtacaatataaagttattcgtgaaattgtggagaacgaccaagcagttcttaaattctattatttagatcctacctataagggtgaagtagattggagaggaactgatacgactgggtttattgagttgcttacaacttccccaacaacctataaagttggtactatatacgattacaatattaattcaaaaattacagctccatttactattgatcctaccaagaatgttatggttttcaaggaaagtgaacagaacgagcaaggtagcaaatatcgcgtcattgctcaatggtcaggagatgaaaccactaaaggtatatatggaaaaatctatatcgctactcaggtttggacgactaaattgggaacaaacgagtggggatggtttgactattctgatgaccaagctggtataaaatttaataacaaaggtttttggccggcaggtgttcaaaatacacttcgaaatgctactccagctacagctgtagagactacttatatctacaaagaaagttccaagtatggtgatgtcattgttgagtactacgatactgacggaaaacaaattgtaaattcagttgtagatactcctaagtcagctcttggcacagagtataatacagatgtggaccgtagaccagccagcttggttgctgctgatgggacagtctacttctacaaagaagttaagtctgattcagctaagacaaccggtacagtagttgcaggtacgacaactgttaagtatgtttacgaaaaagctggtagcgttaatgttaacttcgttgacatcaatggtaaagtaatcaaagctcctgtttcagatgaaaaagatgcgaaacctggttacaattatgataccgacttggatcagaaattagcttccatcacttttgaaggcaaggaatacaaacttgttcctgctggtgattatccggttggtaaagttggcaagggaaataacttgattgaagttggtaataatactgcgaaaggtattgacccaacaacaggcaaaattgaagccggtgttaacaaagaagttacctatgtctatagagcagtgacaggttctgtagttgtaaattacaaagatacagaaggtaatgtgattaaagatccagaaacggatgtgtctgatgcaccggttggagatgcttatactacaactgacaagaaaccaaacgaaatcatcacaaaagatggatcacgctatgttcttgttccatctaagacagatggtgaggaaaatggtaaagttatcgaaggaacaatcacagtaacttatgtttaccagaaagttgcaaactggattccagagattccaaatgtaccagaaacagaccgtccaaaagtaccttacccatttgacccaacagagccagacgagccaatcgatccaacgacaccaggaacaaatggcgaggttccaaatattccttacgttccaggatatacaccggttgatcctaaggataacacgccgttgaaaccaattgatccaaatgatccaggtaagggttatgtaccaccaacaccagaaaatccaggtgttgatacaccaattccttatgttccagttaaaaaagtcgtaactaaccacgttgatgaagagggtaaccctattgcaccgcaagaagagggaacaaaaccaaacaaatcaatcccaggttacgagttcacaggtaaaactgttactgacgaagatggcaacacaactcacatctacaagaaaacaccagaagttaagaatggtacagttgttgttaactatgtaacagaagatggcacagttatcaaggaacctgtaacagatacaccaacttctccagaaggcacaccatacgacactacagacaacaaacctaagacaatcactttcaaaggtgaagagtatgaattggttcgtgttgacggtacagaaaacggtaaagttgtagaaggtgaaacagttgtgacttacgtttaccgtaaagtcgaaacacctgctaagaaagttgtaactaaccacgttgatgaagagggtaaccctgttgcgccgcaagaagagggaacaaaaccaaacaaatcaatcccaggttacgaatttacaggtaaaactgttactgacgaagatggcaacacaactcacatctacaagaaaacacctgctaagaaagttgtgactaaccacgttgatgaagaaggtaaccctattgctccacaagaggatgggacaacaccaaaacgtcaaatttcaggttacgagtatgtgcgtactgtagttgatgaagaaggtaacacgacacatatttatcgcaaactttctaataaaccaacaacacctgagaaggaaactcctgcaaaacctcaagcaggtaaaaccgcttcaggtaaagctcaattgccaaatactggtgaggcttcatctgtggcaggtgcgcttggtacagcaatgcttgtcgcaacacttgcgtttgcaagaaaacgtcgtcgtaacgaagattagtcaaaattctttatacagactttattcccccacatagaaagtataagaattgtacgtaacatgcaggattgcctttccgaaaaaatgaggctgggcaaaaagtccagagttacatcttagagttcgctccatttccaacctccaacagtcactactctgactgttggagctgtgtgggggtgggagacgagctctttttttattcggtcgagttctttctcgctcccatttttttgtcttattttgatatactagatatagtatattcaacgaaagcatgagaatttgatatgaaattagtctatacagatattcgcaatcctctgacgcagtatttgacagaacagacagcaacatttgccgagcagggcaaacgtgttttttatattgctccaaactctctatcctttgagatggaacgcaaggtcttggaatacctgcctgaacaggcaacttttgatattatcgtgacccgttttgggcaattggcccgctatttgatgattgataggaaagaagcaggtcaaccgctggatgatgttggtctggcaatgattttctttcgtgttctatcgcaatttgaagatggcgacttgaaagtctatggtcgtttacagacagattttggtttcattaaccagctagttgctttatacaaagaattgcaacgggcaaatatgtctattttggacttggaagccatggactcaccagataagcaggctgatttggtaaagatttttctggctgtaacagacattttgtccaaagaaggctttgagcatcagtctaagttagcacagttgactggcttggtagaaactggtcagttggatgagcagttgaagaacattgtgctggtggtagacggattttctcgtttttcggcagaagaagaagctttagtaagtgctttaaatgaacgggtgtcggaaatcctgattggtgtatatgccagcaagaaagctgtgcaagccacctatgcggaaggcaacgtctatcaagccaacgttgactttttacgtcagttatcagcgcagttccagactaaggcaacttatattggtcaagagccggtcttggacagtatcggtaaattttcaaagaatatggaagcctattatgactacagcgggaccatgatagacttgactccagcagaccaagaaaaaatccaactctgggaggttgttaaccaaaaagaagaagtggagcaagttgcgactgcaattcgtcagcatgtgcatcaaggtgctcgctataaagacatcttgttgctcttgggtgacgtggatagctacaagttgcagattggcaagatttttgacaagtatgacattccttactatttcggtaaggcagaggagatgagtcatcatccgttggtccattttgtggagtccttggagcgcttgcgtcgctatcgttttcgtgcggaagacctgctcaatctcctcaaatctggtttgtacgccagcatttcccaaaaggagctggacctatttgagtcttacatcctttttgcggatatgaaggggcaggctgctttttcgagggctttttcggtcaatggcagagcagactatgatgctgaagtcatcaaggagaaaaggcttgtctatgatttgactgtcttggaacccctacgtgctaagattatggaacctttgaaccagctgtttaaggctggaccacaatctggaactgccttgcttgagaaatttatggcatttttggaggcaattgatcttcctaaaaatatggaaaaaatgtctcgaaatttgagtgaagtagagcaagaaaaagaagagcaggtctggaaaagttttacccatcttcttgagaattttcatcagattttcggaaaagaaaagttgaaaatggatgattttctggctattttacaggctggaatgcaggccagccactatcgtaccgttcctgcaacagttgatgtggtcaatgtcaaatcctatgatttgatcgagccgcacactgcaaagtatgtttatgctatcggaatgggtcagtcaaattttccaaaagttgccaagaataccagtctattgacagaagaagagatggaaaaagtcaatcttgtctcggctagttcctcacgtttcgatttggtcagccgagagaatatcaagaagaaccatgctgctatgatgtctctgcttaattctgcgacggaacagttagtcatttctactcctcagatttataacgaaggcgaagatagtctctccccatatatcaagattctccaaaaaatggggttgaaatccgaagaacgtggtcggattaaaacacttagtccacaagacatcggtcactacaagagtctcttatcccgtttgattgagtcggaaagaccaagccttgaaacagaggagtgggaagggcagagggccttctggacagtcttggttcgccatttgaagaagaaattggagtcgcaaagcattgaaattccgaccattactggtgatattgcttctaaacaactttcagatgaaaccttggctgctttatatccagaggataagccgctcaatctttctgcatccagcttgaccaatttctacaataaccaatatctttactttgtccgtaatgttcttcgcctgcgggaacaggaatccatccatccgactgcctttcagcatggtttgttcttgcatcggatttttgaacgagtggtcatggaccaatctgagctagattttgatcaaaaagtggacaaggcaattctgcgtacgcgtgacgaggcagaatttgctatgttttataaccaggatgcggatgctcgttatacggaggaggtgctggataagattgctcgttccagtgcgactattttgcgggataatgatttggttgaaattgatggccaggaaaagagtttccgtcaggataaggcgctggtttttgaccttcaaaatggcaagagtgtgcatgtaaatggtaccattgaccgcttggataccttacaaatcaatcaggctgtcggtgttgtggattacaagtccagcgaccaatctttttcagttggggatttttataatggtctcaaacctcagttggtgacctacttggcagccttacaagagctggatgaaaccaaggataaacctgtttttggggctatgtatttgcatttgcaggatccgattatcaaattaaaagacacgaagaatttagaacagctagaaggagctgccaatactagcttggtttacaaggggcttttcttgaaggaggaaagtctggggctcaatcatttttatcagactcgtaaccaactctacacggaagatgagtttgcggttttattgaaccacaaccaagaactatacaaacaagctgccatggacattctggctggtcgctttgctattaacccttataccaaagatgggcgttcggtggcaggtgagcagctgaaggcaatcactggttttgaggcggatcggcacatgggcatggcacggcggttggtcaaagaggccaagcgtcaagattggatggaacgaatgaaaggaggtcaggactaatggcttttgaacaatttttaagcgcggaagaaatcaaggctgtgcagctggcggaagcccattctgataagcagcaaaaacgcacagctgagcagattgaagctatctacacgcacggtcagaatgttctggtctctgcatcggctgggtcaggaaagactttcgtcatggttcaacggattttggataagttgaagcgtggtatagggattgaccagctctttatctcgacctttacagtcaaggcggctggtgaattgaaggagcggattgagaaaaagctcaatgaaactattgcggagacgaccgatatggaattgcgtcggcatttgtcggcccagttggcagatttgactaaggcggatattgggaccatggactcctttacgcagaaattggtgaccacctatggttatagccttggtatttctccgcagtttcggattttacaggatgagactgaaaaagcgagtctgaaaaaagaggtttttgaccagctctttgcagattatcttgaagaggatgaaaatggtgcattccgcaaactggttcgcaatttttcgggcaaccgcaaggataatagtggtttccgtcaggttgtttatcaggtgcatgattttagccaatcgacgagcagtccaactaaatggctgaaagaacaggctgttcaagctgatttgtacagtcaagagcgtatagagcagatgctagagcaaggctttaaggaaaaagtgttagacaagctctatcaagctgcagatttcttccgctaccatgtggaatggggcagaaatgactttgggtctgctaaatattttgcaaatgtggaagaagtcttggatttgttgacaggtttagatagtctggaccagaaggacttgatggaacgggttgaaagaattcttctcatcaataatcagtccagaggcaagggcctgaccaatgccaatcgaccaaaagatgagcatttgatagcctttaaagaagaatacaatgctggtaagagccagattatctcagaactacgagatttgggtcaggaagtttatgaattgaccctgctgaaagactatcaggttcaagctttgccactactgatattattacgtgactttgtcttggatttttcgcaggcttatctggatgtcaaaatcaaggaagcagcctttgaatttggcgacattgggcatttcgctattcgtattttagaagaaaatgcggacattcgccagtttttccaagagaaatatcacgaagtcatggtggacgagtaccaggataacaaccatagccaagagcgaatgctggacctgctgtctaacggtcacaaccgctttatggtgggtgatattaagcagtccatctatcgattccgtcaggcggatccgatgattttccaagagaaatttgaactgtatcaggcaaatcctcagtctgggaaattgattttgctcaaggaaaatttccgtagtcagattgaagtcttggaggcaacaaatgctattttcacgcgcctgatggaccgtcaagtaggggaaatcaagtatgacgacacccacagtctagtggctggtagtcctggtcaaaaaattgcccagcccaagaatgagatggaatacttgatttacgatcagcaggatagcgcaaactcttcaacagatgctgaggaagaaacacctctgactgctggtgaaattgaggtcgttgcaaaagagattattcgtcttcacaatgaagaaggagcagacttcaaggacatcactctcttggtacaaaagcggacgcacaatgacctcattatgtccatttttgaaaaacatgggattccaattgtggcagatggcggagcagcctcctatctgcaatctttagaagtcatgatcatgctggataccttgcgggttatcaataatccactcaatgactatgccttggttgccctgcttaaatcacctatgttccgattcgatgaagatgaactgacacggatttccttgcaggccgggacaggtttcttttaccagaaaatggaaatagcccagcaagcaagtgggcaacatcctgaactgatgtcagaaaagttgaagaagaaaatcacggatttcttgtctattttggaaaattggcgtgcctatgccaaactgcattctatttatgacatgatttggaagatgttcaatgaaaaattctactatgactatgtcggtgcgcttccaaatggcagcaagcgtcaggccaatctatacgcacttggtctgcgtgccaaccagtttgaaaaaacaggctacaagggattgtctcgcttcatcgccatgattgatcgtgccttagcaaatgacaaggacttggcagatgtacaagagtttctaccgcaaaatgctgtacagcttatgactattcacaagtcaaaaggtttggagttcaagtatgtcttcctcatgaacatcgataagcgatttaacttggaagaccattaccaatcagtcatcatcagccggaaaaatggtctaggtatccaatatttagcagatatgaaagataaggtaaatagcccattacctcaggtgcgagtcttaatgaacaccctcccttatcaaaataatctccaagagctaaaaattgccaatctttcggaacaaatgcggttgctttatgttgcactaacacgtgctgagaagaagctgtatctggttggaaagggtaatgctgacaagttagctgaaaaatacgatggcaaaaaggaaaatggcgtactagcccaatcaactcgtgaaagtatggcgaccttccaagactggattctagccattgatgaggccttctcaggagaagacttgcacttcaagaaagtctttgtgacggatgaggatttgacagaggagaagattggtaaacttacattgaagagtaagctagaagacgccagccttaaagatattcgtcaatcagaagacatcgcccaggccttggaccagttgtcttctgtccaagagttgaacgaacgctataaggctgctatagaattgccaagtttacggactccaagtcaaatcaagaagctctatgagcctattttggaacaagaaggcatggaagttatggaaaaataccagcccaaacggaccttcaacttgccagatttctccaagaaaccaaaaatcactggagcccaagtcggttcagcagtgcatgaactcatgcaacgcttggatctgtcttggttggtgacagaagatacggtaagagcagccctagaagctgttcatgctgagcaagcgattaaagataaaatcaatgttcagatgattttggatttctttgatacagacttaggaagagaaattctagccaatacggacaaactccaccgagaagctccatttgcaagtttgcagacagattctgtatctcaggaaaactttgtccttcgtgggattatcgatggctacctactgtatgatgatcatattgtcctctttgattacaagacagacaaatatgaccaaccaatccaactcagccaacgttaccaagctcaaatgcaactctatgcggaggcattgaaaaaagcctacaagatagatcgtgtagactgccatttgattttgcttggtggggagagaatagaagtggtcgaagtcaacatatagtcatttagtttttcttttattacttcgttaactcgctttgccgtactccagtactgtctgcagctcgttgcctagtactaaaagtaaactaaaagactataaataaattaaaagcgagtggttaaactcgctttttctgtttggttagattgagtccgaatgggacaaggttctcttcttttttcaaaatccgctggatattttccttgtgacggatgatgacaaaactgccaagaaagacgataatcactgtaaagagccagtcgtagcttggcaggatgattcctattgctggaaatagcagagctcctaagattgctaaagctgctgctaagacgctagagaaggaaaccatggacgtcaagtagagtgaactggcaaagattagaacgagatagaggcaaaaagcaggtgcgacgcccagaagcataccagcagatgttgcaaccgcctttccacctttgaattgggcaaagatagggaaagtgtgtcccagtacagccattaacccaaatacaatcggagaaattccttgggcatgaaagatcagcggaagcaaggctgccaacgttcccttgagaaaatcaattacaaatacaatcgtaccagcctttggacctaaaatacggaatgtgttggttgttccagtatttcccgaaccatgctcacgaatgttgatattgaaaaaagtttgacctatccaaagtcctgacgggatagatcccaacaaatatgcaataaatagtaaaataagattgactaacatgttttcattatagcatattttcatctaatttagtccaaaatcttattttgtgagctgtctcagccgataggtaacagaaatattttgcaaaaatgctaaaaaacttgtaatatagaaaggatgataagtatggaggtcagttttggctaagaaagagattgatataaataattacaatgacgatgccattcaggtattggaagggctagatgccgttcgcaaacgccctggtatgtacatcggctccacagacggaaatggcttgcaccacatggtctgggagattgtcgataacgctgtcgatgaagccctgtctggtttcggtgaccgaattgacgtgactattaacaaggacggtagtctgtccgtttccgaccgtggacgcgggatgcccgttggtatgcatgcaacaggcaagccaacagttgaagtcatcttcaccgttctccacgcaggtggtaagttcggtcaaggtggctacaagacttcaggtggtctccacggggttggttcttcggtggtcaatgccctgtccagctggttggaagttgagattacccgtgacggagctgtttacaagcaacggtttgagcagggcggaaagccagtcacgaccctagagaagattggtaccgctccaaaatcaaaaacaggtacaaaagttacctttatgcctgacgataccatcttctcaacgacggatttcaagttcaacaccattgccgaacgcctgaaagaatcagccttcttgctcaagcaagtcaccatgactctgacagatgagcgaacaggtgagcaggaggagtatcactatgaaaatggcgttcaggactttgtatcctacctcaacgaagacaaggaaactctgacacctgtcctttattttgaaggagaagatgctggtttccaagtccaagttgctatgcagtacaacgacggctattcagacaatatcctgtcttttgtcaacaacgttcggaccaaggacggcggtacccacgaaacaggtctcaaactagccattaccaaggccatgaacgactatgctcgtaagaccaacttactcaaggaaaaggacaagaacttggaaggctctgactaccgtgaaggtttgtctgcggtcctctctatccttgtgccagaagagcatttgcagtttgaaggacagaccaaggacaagctgggtagcccgcttgctcgccctgtggtggacggcattgtgtcggacaagctgaccttcttccttttggaaaatggcgagctagcatctaatctagttcgtaaagccattaaggcgcgtgacgcccgagaggctgcgcgtaaggcgcgtgacgaatcccgaaacggtaagaaaaacaagaaggataagggccttttgtcagggaaattaaccccagcccagtccaaaaatccagccaaaaatgaactctatctggtcgagggagattcggccggaggttctgccaaacaaggccgtgaccgcaagtttcaagccattctacctttgcgtggtaaggttatcaataccgccaaggcaaaaatggcggacatcctcaaaaacgaagaaatcaataccatgatttacaccattggtgcaggtgttgggtcggatttcactatcgaagatgtcaactatgacaagattattatcatgaccgatgcggacacggacggtgctcacattcagaccctcttgctgaccttcttctatcgctatatgcgaccgctagtagaggcaggccgggtttatatcgcccttccgccgctctacaagatgtccaaaggcaagggaaaggcagaaaagattgcttatgcttggtctgatggagaattagaagatctccgcaaggattttggcaagggctttatcctccagcgctacaaggggcttggtgagatgaatgccgatcagctctgggaaacgaccatgaaccctgaaacccgtaccctcatccgtgtcaccattgaagacctagcccgtgctgaacgccgtgtgtctgtcctcatgggcgacaaggtcgagccacgtcgcaagtggattgaagacaatgtgaagtttaccttggaagagagtacggtgttttagaaattgaaatacaattgtaagactacgttatgaaattacaaatttggaatgaatcttatagtctccaatggaagggaacctattttcttgctttgtctgactatcctaatattcaagattgggaattagagaaaattgtagcttttttagcttatgagaaactttacggcagagagacgctaatagattgtgaagacaaagtaatgcttgaacaacttgtctatttatcttgttgctcacccactgcatttccatttactccttcgaaaaagattgtggcctcaacatatgatgttggtggtaattacgtttattcggattttttaagtcatacgtgtactgtcgaaactgcacaagagattttcatgagtggtcaattattgtccgctgttcgtgcgttcaacaaaactcatcaagaactcgttcaggataatcgaaacgcagcaggtgatccagaagattattttgattatgtcatgctaggttggtcaaatacaagttctggctacagacttgcaatggaaagattactaggtagagaaccaacagaggaagagttggggaattcttttattccaggcgtaagttttcattttaagtacgacgatatagtcaatgcagatggttatgtttttgatggataccaccctgcaaaggtcagggattgtttaagtttgaaatatttgtttgcctgtattgttccttcaagtgaaaaatctcattttgagacaattattcccctagatatgtcttcaaaagtttattatttagactatggtcaggatgggatggcagattggtcccaaaaggtctatcaatttgttgaaaatatagcaaactaatactataaactattcaattcgatgatttgtgataggaatcgattgttcctaacgccgtgtatctgtctttatgggcgacaaggtcgagccacgccgcaagttgattgaagacaatgttaagtttaccttggaggaatcgacagcttttactaaataatctcagggaagttgaggtgccatatggttttagaaaataaattggagattgaaaattcggctgaattagcccgtcttgaagaacaaatcagcaagaaaaaagcagctcaactgttcgaaaatggtcagttattccagatagaagttggaacctttgccggtttggcacacattcatcaagctttatttgaggatatttacgactttgcaggtaagattcgtgatgtcaacattgccaaccaaagataattttcaattcgctccacgtatctttcttgagcagtctttggcctatatcgacaagctacctcacgaaacctttgatgaaatcgttgaaaaatatgcagatatgaacattgcacatccattccgagaaggaaatggacgcagtatgcgtatctggttggattgtatgctacgggatagtttgggtagggttgttgactggaatagcattgataaagatgaatatttcaatgcaatggttagaagccatgtgtcaacaggagagcttaaatatctgttattgcaagccttaacggaagatcttggtcaggctacttatttcaagggcatcgaccattcttattactatgagggttacaacctatatcgtattgaggatttgtaaatctagcataaacaaatgatgtgaggtgttttatgccactaagagtaaaattaactgaccgttttcaaaaacggttgtctgaatgggcacgaaagcgcaagccatttaaaaacaaacaggagttggaagagaaatttggccaagcattgaagatttggcaatcttccaaaactcggcaacatgcagaaaacttgctatctgagcaaggaaaattagaacattttttacatagcacggaacggaaactgtctcgtatgccttttggcggagataagtttgcggctattccaggcttgatttccatggtgcgaagctatatccgtagagattacagcaagttacccaaagcgacaatcctcgcaattataggtgctttgatttattttttcagtcctattgatgccttaccagatttcatccttggagcaggtctacttgacgatgcctttgtccttaatgcctgtttgaaattaatcaaaacagatgtcgatgactttagaagctggcaagcaagccagtggaaggcggaagagtagctatgataaagtttttaagaaaaaagccaactatcgagcaacttaagaaagttccttatgcttctcagtatacagaggttctacgttcaatttggcgagcagatgtgcctaaatacgggatttcttctactttacaaggtgaattacttcgacaattagaaaaacttcgctgggaagctcaagcaaatggcaatgtcaattggtgtgaagagcactcaaactactgtcgattcataaaggagactctctataaaggaaaactcctttcttctcaacagaagcaagagttagttttaataatggattatctaaaatcgtgtggtgaatatgctcaagcttatcaagaaaatttgattgatgatgaggaattagaaattgagaaattagcatatgttgatgacaatctttatgatagagtaggggatatgattgctttcttttatcagagaacttaggtaaagaactaatgtttagttaaggatatcgcaacagaaattgctatataagctctcttccgttcccactacttaaggtgattatcaaaaaagtaaaaaagaaagaaaatttaacttcccaccaagaaacaaagaaaggaatgttcggttagtagaaataactgaacacgggactgaatcgtccctttgtatcttaatttatgtcaaacattcaaaacatgtcccttgaggacatcatgggagagcgttttggtcgctactccaaatacattattcaggagcgggccctgccggacattcgtgacggtctcaagcccgtgcaacgtcggattctttattctatgaataaggacggcaacacttttgacaagggttaccgtaagtctgccaagtcagtcggaaatatcatggggaatttccacccgcacggtgattcctctatttatgatgccatggtccgcatgagtcaggactggaagaaccgcgagattttggtggagatgcacggaaacaacggttccatggacggcgatccgccagcagctatgcgttacaccgaggctcgcctttcggaaatggctggctatctcttggctgacatcgagaaaaagaccgtaccatttgcctggaactttgacgatacggaaaaagaacccactgtgctaccagctgccttccctaatctcttggtcaatggagcgacaggaatttcagcagggtacgcgactgacatcccgccgcataatctagcggaggtcatcgatgccgttgtctacatgattgatcatccaacagctaagttagaaaagttgatggagttcttgcctggaccagacttcccaacaggtgccattatccaaggggctgacgaaatcaagaaagcctatgaaactggtaagggccgtgtcgttgtccgtagccgttgtgaaatcgagcaactcaaggctggtaagaaacagattgtcattactgagattccgtatgaagtcaacaaggctgttttggtcaagaagattgatgatgtccgtgttaacaacaaggtgcctggtattgccgaggtgcgtgatgagtcagatcggacaggtctgcggattgccattgagctgaaaaaagatagcgatgagcaaaccattctcaactacctctacaaatacaccgacctacaaatcaattacaactttaacatggtggcgattgataatttcacaccgcgtcaggttggcttgcagaagattctgtccagctacatcgcccaccgccgtgagattatcattgcccgttctaagtttgacaaggaaaaagcagagaaacgccttcacatcgtagagggtttaatccgcgtcgtttccattttggacgaggttattgcccttattcgtgcttctgaaaacaaggcggatgctaaggaaaacctgaaaatcagctatgagttcagcgaggagcaggcagaagcaatcgtgaccttgcaactctaccgcttgaccaataccgacattgtgaccttggaaaatgaagaagcagccctacgcgagcagattcagaccttggcagctattatcggcgatgagcggaccatgttcaatcttatgaagaaggaactgcgtgaggtcaagaagcagttcggcaatcctcgtttgagtgaattgcaggatcaggcagaaacgattgagattgatactgccagtctgattgtcgaggaagaaacttttgtcagcgtgaccaaggcaggttacatcaaacggacaagtcctcgttctttcaatgcctcaacgcttgaagaaatgggtaagcgggatgatgaccagctgattttcttgcagaatgccaagacaactcagcacctcttgctttttaccaatcttggaaatgttatctaccgacctgttcatgagttgacagatattcgttggaaggacattggtgaacacctgagccagactctcatgaactttgataccaatgaagagattatcttcgctgaattggtagagaattttgaagaggggacttatttcgcggtgaccaaatacggtcaaatcaagcgtgtggagcggaaggagttcacgccatggcggacttacaagtccaagtcaaccaagtatgccaaactcaaagatgcagaggatgtggttattactgtatcgcctgtagtcttggatgacatcatgctcatgacagaaaagggctacgctctgcgatttaacatcgaagaagtgccaatcatcggtgccaaggcggccggtgtcaaggcggttaacctcaaggacgaggatgtggtggctgcggcctttatcagcaataccagctccgtctatctcctgacccagcgtggtagccttaagcggatggcgacggaggaaatccctgtgaccagccgtgccaagcgtggtttgcaggtgcttcgcgaactcaaggctaagcctcaccgtgtctttgcggcaggtccagtcttgacggatcagggtgattttgatctctttagcacggcaaatgaagatgatacgacaagtcaaatccttcacgtgcagtccaaaacaggcaaactctatgaggttgatgtgacccagcttagcctgtctgaacgcactagcaacggtagcttcatttcggataccatttccgatgaagaagtcttcagagcctggatagactaaaaaagatgaaaagattgctcgcaaagaagtctttttgctatactgtagaggaggtaaatgctatgaaaattatcaaattatttttcagtataaaagtctatctatggcttgttctgtccttccttctgttattgtgtggtgtatggggatacggctacatctctggtgaaaagagtaatcagcaggaagtgagtgtccatgcggctattgagtctgtcgagcaagtcaatgaattggtatttctaaatacagctgtccagaaaattgtgaccgctaaaaactacacggtcttatttggtcaagaaatgcccttctcagaaaaatcagccctcttaattatcaagtacaaagcaaaatttggtatcaaaagtcctgtatccattgaacatctttctgaaaatcggtacaaaattacccttccagcctttgaagtcattggattggaattagatgcagaagaaccttataccttatatgataagagtggtgagatactgagttttgcgacagaagaaatcgatactgcccaactcatcacagatgaatttcagtcggtagagcaagaaaagtttttagcagattatcaggaagacataaaagagtcagccaaaaactactatcaaaatttatttagtgctatctcacctgaaattcaactagaatttgtttttaaagagtaagagtctggtttaccaggctttttcttatattcacaaaattttctgaatttttaattgaaaatcactttcaaaagtagtaaaatattaaaaaatgaatttggagaaactatatgacagtgaacattgactgggaaaaccttggtttttcttatatgaaactaccttaccgcttcatcgctcatttcaaaaacagccaatggtctgaagggcagttgaccgaagatgcggaattgcacatttcagaaagctcaccagcccttcactatggccagcaggcttttgaaggccttaaagcctatcgtaccaaggatggaaaactccagctctttcgtccagaccaaaacgctgagcgcctgcaacggacagctgaccgcttgctcatggagcctgtaccgacggatcttttcatcaaggcttgtaaagaagtggtcaaagccaatgcagactacgttcctccctatggaactggtgggaccctttatctccgtccgctcctgattggtgtcggcgacatcatcggcgtcaaacctgcggaagagtacattttcacagtttttgccatgccggttggtaactatttcaaaggcggcctggctccgaccaacttcctcatccaagacaagtacgaccgtgcggcaccaaatggaacaggggcagccaaggttggtggtaactacgcggcgtcgctcttaccgggccaatatgccaaaaagcagggcttctcagatgtcatctacctggatccagctacccacaccaagattgaagaagtggggtctgctaatttctttggtatcacagctgataacgagtttgtcacaccgatttcaccatcaatcttgccgtctattaccaagtattctctcttgtacttggcagagcatcgtctgggtatgaaggctgtggagcgtgaagtccttgtcgaagaattagaccagtttgtcgaagcaggagcttgcggaacagctgcagttatctcaccaattggtggtatccagattgcagacaaactccatgttttccatagtgaaacagaagtaggacctgtcactcgtaaattgtatgaagaattaacaggtatccagtttggtgatattgaagcgccagaaggttggattgtcgaagtagattaatttcagaaggcttgcacttgcaagctcttctctttttttgtagaatagtaaaagtgaggtttgaaaatgagtaaaaaagataaaaaaattgaaattcagattgaagatagcaaagttcttgtcaatagagaagagttccctggctaccgccttgttataggtaaaaaagtaattggagaaattgcagaattggctgaaaataactttgcagttattaaaaacggaaataccgaaagcttttacaaaaaattagaaaaagcagtcggaaatattattgaaaattataatttaagtcactaaaagacttgtaatagtcgctattttatgttagaatagtgactgttagtgtacggagagatagcgaagaggctaaacgcggcggactgtaaatccgctccttcgggttcgggggttcgaatccctctctctccattgaacaggatacaaaggacgttaagaaatccgtacgaaaataggaaattgacgcagtgtgctaaacacacagggaagtttatctttttcactaggattttagtccgtgttcaactaagatacgagatatgttctggtttaccagaaatttctgtagaaaattaggagactgacgctgagtgttaacactcaaggaaggctatctatttttctaagaaattaatctcgagttcaatttcttatgattagtaaataaatgaattgtatctattttttggggtatcgccaagcggtaaggcaagggactttgactccctcatgcgttggttcgaatccagctaccccagtaaaggtactagatatagtctagttcgtcaaagatgtctaattgttgttgtccttgcgtgtgccttaaataaaatatattttatgttgggtcgaaagacctgattgtcggaggtttttttataatgaacgaatttgaagatttgttgaacagtgtaagcgaagttacacctggtgatgtggtaactgcagaagtattgacagttgatgctggtcaagcaaacgtagctatctcaggtactggtgttgaaggcgtattgactcttcgtgagttgactaacgaccgtgatgctgatatcaacgaccttgtaaaagttggtgaaacacttgaattgttagtacttcgccaagttgttggtaaagatacagacactgttacttatcttgtatctaaaaaacgtttggaagcacgtaaagcatgggacaagcttgttggtcgtgaagaagaagttgttacagttaaagtaactcgtgccgttaaaggtggtcttgcagttgaatttgaaggtcttcgtggtttcatcccagcttcaatgatcgacagccgtttcactcgtaacactgagcgttttgtaggtcaagaatttgatgctaaaatcaaagaagttgatcctgctgagaaccgtttcatcttgtcacgtcgtgacgttgttgaagctgcagctgcagctgcacgtgctgaagtattcggtaaattggcagttggtgaagttgtgactggtaaagttgcacgtatcacaagcttcggtgcattcatcgaccttggtggtgtagatggtttggtacacttgactgaattgtctcacgagcgtaacgtatctcctaaatcagctgtaacagttggtgaagaagttgaagttaaagttcttgcaatcgatgaagttgaaggtcgcgtatcattgtcattgaaagctacacagcctggtccatgggatggcgttgagcaaaaattggtagctggtgatgtaatcgaaggtaaagtaaaacgcttgactgacttcggtgctttcgttgaagtattgccaggtatcgatggtttggtacacatttcacaaatttcacacaaacgtgttgaaaatccaaaagacgctttgtcagtaggtcaagaagtaactgttaaagttcttgaagtgaacgcagctgatgagcgtgtatcactttctatcaaagctttggaagagcgtccagcagcagttgaaggtgaagaaaaagctgaaaaacgtgctccacgtccacgtcgtcaaaaacgtgaagaaaaacgtgattacgaattgccagaaactcaatctggtttctcaatggctgatcttttcggtgacattgaattgtaattcatataaaaacttgccttgtgcaagtttttcctttccacccttagtgtaatggatatcacgtaagattccggttcttgagatgggggttcgattccctcagggtggactaaattgaaaagcctgcattaacaggcttttttgttatattatatcaaggaggctatgatatgttacattttgaaaatgactataacaaaggtgcccatcccgccttgctagaagccttagttgcaagcaaccaagaaggtttatctggatatggcactgataaatatactgaatctgctatcgaaaaaatcagacttgctacggactgtcctcatgcacaagttacgtttttagcaggtggcacgcagaccaatcaaattgtcatttcgtctatgttagcttcctatgaaggagtcattgcagcggatactggtcatattgcagttcatgaagcaggggcaattgaatttacaggccataaggtgttggccttaccgcatacggatggcaaacttgtcgcaagtgaagttgagaactatatttccgatttctacgcagatgctaatcatgctcacatggttcatccaggaatggtttatatttcccatccaacagagtatggtacactttatagcaagtcagagttagaagccttgtcaacagtttgtcgtcatcataacatcccgctttttttagatggagctcgtttgggttatggtcttgctgcacgcgatacggatcttgatttgaagacaattgcagagctgacagatgttttctacattggtgggacaaaactcggtgccttgatgggggaagctttggtatttacaaagaacaaccagcctaagaatttcgtatcgattgtcaaacaccatagtgccttgttggcgaaaggaagagtgacaggtatccagtttgattgcttatttactgatgacttgtatcttgaattggggcgtcatgctatagcaatggcagagcaactgacccagattttggaagagaaaggctttcaattctatctcaaatccccgaccaatcagcaatttgttattgttaagaatgaagaattgactagattgacagaagttggaattgcctatggcttctgggagaaatacgacgatagccacagtatcatccgctttgcgaccagctggtcaactagtcaagcggatattgatgcgttaaggaatagattataattaataaaaaagaaagggttagcctttctttttagtttgtaaataatgatagcgataaactgcataacgttcaataaggcggtagcctattccccctgcgattgcatgtacaatcagggcaatgtgcaattctagtggtgcttttatagtgataccaaatagaataccgattacagtccatcctagtatcacccaccataagtacttaaatggagcatactgaccatcctggtctttaacttcactggaaaccctgattgaacaaccggtcaatactcccatggggagcaatgaacgagtatcaaatggttctggtaaaaatgacgataaggcgaagatttgtataagcgcaaaaatcagtagccaaacgaaaatcggcgtttttagaatgacgtatttcatattgcacacctcttgaaattagtatatcaaatccaagaatgtaaaacaaatatttttgtgctattgattagaagtcgtttcggatgccccactagttacctctgtatcagtactggtttctgtccttgtctccaaagcttgggtagcagacgtttctgtagacgaggaagagacagtcgactctactaaagagctggtctcggtttgggttgaggatgttgtttcggagcttgaacttgttgaatcttgtacttctgttaatggattgtcgcttgatgattggctggggctagtggcgctggatgatgaaatggtagtacttggagatgttgaggatgttgcaggttttgctgtaaaggtgtagatagtgatgcaggcagtgataatccctaaaatagacccgataaaggttaaatatttttgaaaattagttaaaccagccggttttttatttgtattcttacgtgtattcatgatgtacctccacctttagtttaagataggaagtttaaaactatcttaaagattgccgaaaggcatgaaaacatgataaaataggactattgcaataaaaggaatataaaaaatgatttattttgataatgcggcaacgacacaggtctatccagaagttctcaagacctatacggaagtggcgacaaaaatctggggaaacccctctagcctccatagtctaggcagtcaggcaacccgtattttggaagcatctcgcaagcaaatcgcagaattgcttggccaggatagcaaagaaatctttttcacctcaggtggtacggaaggtgacaactgggtcatcaagggagtggcatttgaaaaggcacacctgggcaagcacatcatcgtttcggctatcgaacacccagccgtaaaagaatctgcgctttggctcaaaacgcaaggttttgaggttgatttggctccggtcaatgcccaaggttttgttgatgtttcagccttagaaagcttgattcgtccagataccacactggtttctatcatggccgtcaacaatgaaattggtgctattcagcccattcaggaaatatctcaactgttagctgataagccaaccatctcattccatgtggatgcggtgcaggctatcggcaaagtgccgacggaacggtatttgacagaccgagttgattttgccagtttttcaggtcacaaattccactctgtcagaggagtaggtttcgtctatatcaaagctggcaagaaaatcgctccgctattgacagggggaggacaggaaagcgataaacgctcaaccacggaaaatgtggctggcattgctgcgacagctaaggcgctccgcttgaccttggacaaggcagcagatagccaaaagcgactggcagccatgaagcagatccttgtggatgaattgggcaaatacgacgatgtgacagttttttctgggctagaggactttgtgcccagtattgtaactttcggaattaaaaacatccgtggcgaggtcattgtccatgcctttgaagaccaccagatttacatttcgacaacctcagcctgctcgtccaaggctggaaaaccggctggaaccctaattgctatgggggttccgcagaagttggctcaaactgccgtccgtatcagcttggatgatgacaacgatatggggcaaatcgaacaattcctcacgattttcaaacaaatttatcaaaacacacagaaagtaaggtagaatgaactattcagaaattatgattcgctatggcgaattgtcaactaaagggaaaaacaagatgcggtttgtcaacaaactccgcaataatatcaagcatgtcctttctgtttacccagaagtgaccgtttattttgaccgtgaccgtggtcatgtctatttgaatggggcggattatcaggaagtttcagcttctttgaagaagatttttgggatccaaaatttcgcaccgtcttataagattgaaaagtctgttccagctttgaaagaagcggttgtggaaataatgcagaccatttacaaggaagggatgaccttcaagattgctgcgcgtcgtagtgatcacagttttgaattggacagccgtgaccttaaccaagtccttggagatgcggtttttacagctattccaaatgtacaggtacagatgaagtcaccagatattaccttgcgagtggaaatccgtcctgatgctgcttatatttctcatgaagaaatcaagggggcaggcggtctgccagttggaacatctggaaaaggaacgcttatgttatcaggtggtattgattcgcctgttgcgggctatttagcactgaaacgtggggttgaaatcgaagccctgcactttgcaagtccgccttatactagcccgggtgcgcttaaaaaagcccatgatttgactcgcaaattgactgcctttggtggtaatatcacctttattgaagtgccgtttacagaaattcaggaagaaatcaaggaaaaggcacctgaagcttatttgatgaccttgacacgtcgcttcatgatgcggattacagaccgagtacgggaagagcgtggtgccatggttattatcaatggtgaaagtctaggacaagtggcaagtcagaccctggaatccatgcaggctatcaatgcggtgacaaatacacctgttatccgtccagtcgttaccatggacaagttggaaatcattgatattgcacaagaaattgatacctttgatatttccatccagccatttgaggattgctgtaccatctttgcccctgaccgtccaaaaactaaccctaaaatcaaaaatgtcgagcaatacgaggctcgaatggatgtagaaggcttggtggaacgagctgtggctgggattatcgtaactgaaatcacaccgaaagaagaagtgaaagacgaagtggatagtttaattgaagacttactgtagaattcaattgttttggcatacatttaaatccagctattgctggattttttaatacgaatcgttcggaaaaatcgaatttgtatgatataataagacttcagaaaaaaacaaaggagttattatgaaaaaaggagcactaacaggattactcctgtttggtatgttttttggtgcaggaaacttgattttcccacctgcacttggtgtcttatctggtgagaatttctggcctgctattttaggatttgtcgtttcgggtgtcggtattgcagtcattgccctgattgtcggaacattgaaccccaaaggttatgtacatgagatttctcgcaagatttcaccgacttttgcaacgatttatcttgttgccttgtatttggcgattggtcctttctttgccattccgcgtacagctacaacgtcctttgaaattggtattgcgccattattgggcgatgcgaatctcggtctttggttgtttggctttacagctctatactttgtggcagcttatctgattgccctcaatccatctcaaatcttaaatagtatcggacgtattttaacccctgtttttgcgattttgattgtgattttggtggtgcttggtattgttaagtacggatcaacaagtccgttaccagcttcggaagcttactcagcaggacaggcatttggtacaggatttatcgagggatacaatacactcgacgcacttgcttctattgcttttagtgtcgtagcagtaaataccttgaaacaacttggtttctcaagcaaaagggaatatgtatcaactatttggtctgttggcttagttgtagccttggcattctcagctctatatgttggtttggcttttttaggaaatcattttcctgtgcctgcggatgttttggcttccgataccaacaagggtgtttacattctttcgcaagcaacacaggctatttttggaccaggtgcacaaattttcttagctgctatggttatcgttacttgctttacgacgacggctggcttgattgtttcttcaggtgaatttttcgctgagcgtttcccacgttttagctacaaagtatatgcgactatctttaccttgattggctttgggattgccaacctcggtttgaacaatatcatcaccttctctgttccagttcttttggttctctatccaatcactatctgtattgtcttgattaccattgttaacaaatttgtaccgctttcgacttatggtatgcaattaactgtgggacttgtgacagctttgtcattggtagaagtgttagcaggacaattcaactggactgctgtttcaaaaatcatctcagctctgccattggcaggacaatcattagcatggttattaccagctcttgtcggaatcgtcctctctctattcttaccaaacaagcaggagagcgaagtttttgaaatgtaaaaaaatgatacaaaacacttgcatttgcaggtgtttttgttataataggactgttgactatgcacacatcctgtgcaaccgcacgaatgccgttctttcgttgagagtagagtaagtggttcgtcccacggtactaggcgagtcttcacatcaaattcgggtaagacccaaaaatcataggaggtgcataatgagcacatatgcaatcattaaaactggcggcaaacaagttaaagttgaagtcggtcaagctatctacgttgaaaaattgaacgttgaagcaggtcaagaagttactttcgaagaagtagttcttgttggtggtgagaaaactgttgtgggtactccactcgtagcaggcgctactgttgttggtactgttgaaaaacaaggtaaacagaaaaaagttgttaccttcaagtacaaacctaaaaaaggtagccaccgcaaacaaggtcaccgtcaaccttacacaaaagttgttatcaacgctatcaacgcttaatcgcgtagcttgaagcaatcattacagaaattcggaggaataacatatgttaaacttgaatcttgctaacttgcaatttatggcccacaaaaaaggtggaggttcaacgtcaaacggtcgtgactcacaagcgaaacgccttggtgcgaaagctgctgacggccaaactgtatcaggtggttcaatcctttaccgccaacgtggtacaaaaatctatccaggagctaacgtaggtcgtggtggagatgacactctttacgctaaagtagaaggcgttgtacgcttcgaacgtaaaggtcgcgataagaaacaagtatctgtttatccaatcgcaaaataagtctgaaaatggctttacaataggctttccgagttgttttcggagagtcttttttgtaatttgattttgctatttttaaaagtgtacgatagaagtgatttaagacggcaatatcttctctataggataaaaatattttgccatctgcactgttgcgctgcctataagttctacgttcagtagtagatgaaatgttcagaggaagtggtatgggttccaacttagtaaaattagtcattgatgatttggcgaacagaaattccaaagcctttcaaattgcagttgaagaagagaaattgggaacctggaagttatacaagaaattagttttgaagaacaggacgggctagtctatttgcgaaaacgcaagagttcagcaaattcttgctttttttgatataatggtagaagcagttttaagaggtatcaggtatgaatattcaacaattacgctacgttgtagccattgcaaacagtggtacatttcgagaggcggctgagaaaatgtatgtgtcccagcctagtttgtccatttccattcgtgatttggaaaaagagttaggttttcaaatttttagccgaactagttcaggaacttttttgacacaaaaagggatggaattctatgagaaagctcaggctttagttaagggatttgatcagtttgagcatctctatttgcaacctgaggaaggtgagaagactttttcaatttcaagtcagcattatgattttcttcccccattgattacggagttctctcgtagccacccgcagtaccctcattttcgcatttttgaatctactacagtacagattttagatgaggttgctcaaggttatagcgagcttggtattatttatttgaacgagagaaatacaaaaggaatcatgcagaaattggataaacttcacttgcaagctgtagatttgtctgcatttcagactcatatctaccttcgtgaagatcatcctttgacaaagaaagctgagattgatccagtagatttggtaggtctacctaccgtacggttcactcaagaaaaagaggcttatctttattattccgagaacttgattgatacgtcggattcctcggtggtgtttgatgtgacagaccgtgctactttgaatggaattttggagcgtacggatgcctatgcaactggttcgggctatcttgatgacgagagtgtcaatggcattaccgtaattcctctcaaaggaaaggtagacaatcgcatggtctacgttaaacgagctaatgatgaacttagttcttgtgccaaagactttattgaaaccatgcaggcatattttgataagaagaaggatgaaaatgcgtaaaattggatttccatttttgatggtagtattaattggtttggaccagtttgtaaaagcttggacagttgccaatattgaattagatacggtaacggaatttataccaggattgatgagcttagcttatctaagaaattatggtgctgcctggtcgattttacaaaatcagcagtggtttttcacgataatgacaattgttgctgtgacaggcctagtgtggtactatatcaaacagattaagggcaatatctggactttattcagtctgtctttgatgattgctggtgctcttggaaattttattgatcgtcttagattgggatatgtggtggacatgtttcacttggattttattagtttccctgtatttaatgtagcagatgtttgtctgacagttggtgtaggtattttatttatttgtattatgaaagaagagagtaatggaagtaagagttgaggttggtggtattcgtttggataaggcattgtcagatttgacggatttgtctcgttcggttgcaaatgagcagattaaggctggtcaggttttggtcaatggacagcctaaaaaagctaaatatagtgtgcaggttggggatgttctaacctatcaaattccagaagtagaagaaatcgactatgttgctgaggatattcctttagagattgtctttcaggacgaggatgttgctgttgtaaataaacctcaagggatggtcgttcatccgtcggctggtcacacgtctggaacgttagttaatgctctcctttatcacgtaaaagatttgtcaggcatcaatggtgtcttgcgaccaggtattgtccatcggattgacaaggatacatctggcttgctcatgattgctaaaaacgatgatgcccatacaaagcttgctgctgaattgaaagataagaaatcccttcgtaagtattgggccattgtacacggcaatctaccaaacgatcgcggagtaattgaggcgccgattggtcgttctgaaaaagaccgcaagaaacaagcggtgactgccaaagggaaagaagcggtgacacgttttcaggttctggagcgttttggtgactacactttggtggaattgaccttggaaacaggacgaactcaccaaattcgcgtccacatggcttatattggtcatccggttgcgggtgatgaagcttacggcccaaggaaaacactaaaagggcatggccaatttcttcatgccagaacgcttggatttacccatccgagaactggtgaggttgttgaatttacggcagaagcgccagctatttttcaggaggcacttgaaaaactgcgcaaggctgaataatagtatgaaaaccttatcatcttgcccattttttcaacaaatgctatactagaacatgaaaaatgttaaggagagtaagaatggaaactttaccaaattgtccaaaatgtaattctgaatatgtctatgaagacggtgccctcttggtttgccctgagtgtgcatacgaatggaacccagcagatgtagctgaggaagaaagtggacctgttgcaattgatgctaacggtaatcgtttggcggacggcgatactgtgacgcttatcaaagatttgaaagtgaaaggggcgcctaaggaccttaaacaaggtacacgtgttaaaggcatccgtatcgttgaaggtgatcacaatattgattgtaaaatcgatggtttcggtgccatgaagttgaaatctgaatttgttaagaaaatctaagagagaggactggttaaccagtcttttcctgtttttgaaaggatattatgaaacatcaaagtattttgttttacagtagatgcctgttagctattttagccatcacaggtaccgccttagaaatcattaaatattgtatcgggatgctcatgtattatacggtacaatctaatttattagtatctctgttcgctgtctatatggtctatgccatgagtaagggtgtggatttacagacgtcacgttttcttcggataaaggctgctgtaaccatgtctatcatgattacctgtgtagtctatcactttatgttggcacctttggcagacgatttctggcgacttgaaaatctactctgccattatattgttcccttatattttttgttagataccctaatagtagatcgtcagcaacagtacaagtggtttgacccgatttggtggacgcttttgcctgttctttacatgatttttggtctagtgaatggtcttttcataaaaattccaatcccagatgctaaggacagtccttttgcttatttctttctcaatgtccctaagtatggttggacctatgttttgacttatgctggagtcatctttgtcgcctatctagtctgcggttttctattggcgggactaaaatccataaaccttaagacttcattgtcttttggaaaaaattctcagtaaaatccgataatttctatattttttcagaaaaaaattgtcaaggctgagattttatgctatactctgcttaataaatcctttaaaacctgtccagagaggcagacaaggagtcggatgttaagcaggttggttctaactagcctatattttcatagtctccttgtataaggagactttttctatacttttggaggtcttatgaagacaaaagaaatcgttgacgatatgactatgaaacgggcaatcacccgcatcacttatgaaattatcgaacggaataagaatttggataatattgtccttgcagggattaaaacacggggtgttttcattgcaaagaggattcaggagagacttaagcaattagagggtatcgacgttccgttgggtgagttggataccaaaccgtttcgagatgacatgaaggtagaagatgatacgacaaatatgactgccaatgtcaacgatcgtgatgttatattagtagatgatgtgctttatacaggacgaactattcgtgctgctattgacaacatagtgtccttgggccgtccagctcgtgttagtttagcggtacttgtggatcgtggacacagggagttgcctattcgagcagattatgttgggaagaatatcccaactagccgttctgaagaaatcattgtgcacatggctgaaatcgatggtcaagacgctgttcttctggttgaaggtgcatagtcgcttcgtttacaaattctcattctacatctagatcataaaggtaggtatcatcatgacaattacaaatggtaaagtttcactcaaacacttggttacaatggagaccctctcaaatgaagaagtattgggactcattcaacgtggtattgcttttaaacgcggtgaaaaggtagagttagatcggaagtactatgcttctaaccttttctttgaggattcaactcggacgcataagtcttttgaaatggcagagcttcgtttggatatgggaatgattgactttgatgctcgtaccagctcagtcaataagggtgaaaccttgtgtgataccattttgaccatgtcggcacttggggtagacatctgcgtgattcgtcactcggaagtggattattacaagcaattgattgatagtcctaccattcagacttcaattgtcaatggtggtgatggttcaggtcaacacccaagccaatccctacttgatttgatgactatttatgaagaatttggaacttttgacggcttgaagattgccattgcaggtgatattacacactcacgggttgctaagtccaatatgcaaattttgaagcgtctgggagctgagattttctttgctggaccggaggaatggtacgcagaggaatttgacgtctatggtcagcatttgaatattgatgatattgtggaaacggtagatgtactgatgttgctccgtgtgcaacacgagcgtcatgatggtgatggtggtttttctaaagaaacttataaccgtttgcatggtttaacagaggagcgctacaaacgcttgaaagatactgcaattgttatgcatcctgcccctgttaaccgcgatgttgagattgatgattctctagttgaagcacccaaatcacgtattgtccgtcaaatgcagaatggtgtatttgtccggatggcgattttggaagcaattgtcaatggcaaggcttaaaagtaagctgttcaggtatcttagaactgagcagttagaaatttgttagacttatcttatttaatgtcgcccagagaggcgacgaatagaaaggagaaggtacaggttcgagtaagatttgatttttatattcgaacacgccctaaggactgtgtgaaaaagataaatatcgacttgacgcctatagcgtcggcgccgaatttcctattttcactttgtccttttaacgggctttgtatcatagattatgtcaaaaagacgtttaattttggaaaatggcactatttttgagggggaggccttcggtgctgatattgatgtgactggtgagttggttttctcaactgggatgacaggttatcaggaatccatcacggaccagtcttataatggtcagattttaacctttacctatcccttggtaggaaattacgggattaaccgtgatgatttcgagtcgatcaaaccgacttgtaagggagtggttgttagcgagtgggctcgtcgagcaagtaattggcgtaaccagatgactttggatgaatttttaaaggctaagaaaattccagcaatttctggaattgacacacgcgccctaactaaaattattcgtcagcacgggaccatgaaggcgacattggcaaatgttggtgattccgttgagcatttgacagaccagttgagagcgactattttgccaaccaacaacatccagcaagtatcgacaaaaacagcctatcctgcacctggagttggacgtagtgttgttttggttgattttggattgaaacattctattcttagagagttagccaagcgtgattgcaatgtgacagttgtcccttatgatacgactgctgaagaaattcttgccctcaatccagacggtgtcatgctttcaaacggtcctggtaacccagatgatgttccagaagctttggacatgattcggggcattctcggaaaaattccaatttttggtatctgtatggggcaccaactctttgctaaagcaaatggggcaacgacttataaaatgaagtttggtcaccgtggtttcaaccatgctgttcgtgaaattgcgacaggtcgagtggactttaccagtcagaaccacggttatgcagtggctcgtgaagatttacctgaatgtttaatgattactcatgaagaaatcaatgacaaatcagtagaaggggtacgccacaagtactatccaggtttctctgttcaattccacccagatgctgcacctggtccacatgatgccagctatttgtttgacgaatttatggaattgatggattcgtttaaaaaagggcagtaaggcttaactactatcgagctaaaccttactgcgtcggtcagagcaagtcggacttcatgctaacgcatgtgtcctcctacgcaaagtccaatgggacctttgctaactctgacactagtttagaatttcaattattatcgaattgagattctaaacgtcggacttatcttatttaatgtcgctcagagaggcgacgaatagaaaggagaaggtacaggttcgaataagatttgattttcatattcgaacacgccctaaggactgtgcgaaaaagataaacgtcgtcttgatgcttgaagcatcagcgtcgtgtttcctattttcgctttgtcctcttaacgggctttgtatcatacattatgccaaaacgtacggatattaagaaaataatggtgattgggtctggtccgattgtgattggtcaggctgcggagtttgattatgctgggactcaggcttgtttagccttgaaggaagaaggttacagtgtggtcttggtcaattcaaaccctgcgaccattatgacagacaaggaaatagcagacaaggtttatattgagccaattacgcttgaatttgtcacacggattttacggaaggagcgtccagatgctttcttgccaactcttggtggtcagactggtctcaacatggccatggaattgtctaaggctggtattttagatgagcttggagttgagttgttgggaactaaactgtctgcaattgatcaggcagaggaccgcgacctcttcaaacaactcatggaagatctcaatcagcctattcctgagtcaacgattgtgacaacagttgatgaggctttggaatttgctgctgaaattggttatcctgtcattgttcgaccagccttcacgctgggtggtactggcggtggtatgtgtgccaatgaagaagaactacgtgaaatagcagaaaatggtctaaaattgtcaccagtgactcagtgtttgattgagcgttccattgctggtttcaaagaaattgaatacgaagtgatgcgggatgcggctgacaatgccttggtcgtatgtaacatggaaaactttgaccctgtgggaattcatacaggagattctatcgtatttgccccaacgcagacgctttcggatattgaaaaccagatgttgcgtgatgccagtctcagcattattcgcgccctcaaaatcgaaggtggctgtaatgtgcagttggcattggatccacatagtttcaaatattatgtcattgaagtaaacccacgtgtgtcccgttcgtctgccttggcatccaaagcgacaggttatcctattgccaaattggcagcaaaaattgcggttggcttgaccttggatgaaatggtgaaccctgttacaggaacaacctatgccatgtttgaaccagctcttgactacgttgtggcaaaaattccacgtttcccatttgataagtttgaaaaaggggaacgccgccttggaacgcagatgaaggcaactggggaggtcatggccattgggcgtaatatcgaagaaagtctgctcaaggcctgccgttctttagaaatcggtgtttaccacaatgaaatgccagaactcagccaagtgacagatgaccaattggttgaaaagattgtcaaggcacaggatgatcgactcttctatctttcagaagcccttcgacgtggctataccgtagaagaactggctcaattgacgaagattgatcttttcttccttgataagctgcttcatatcttagaaatcgagcaggaattggcaacgaattttgataatattgatttattgaaaaaagccaagaaatacggttttgcagaccgcaagattgcggaactctggggacggacagaatcctacattcgtcaactgcggacagaacacaagattgtccccgtttacaagatggtagatacttgtgcggctgagtttgaaagtgctacaccttatttctattcaacttatgagtgggaaaatgagtccatccgttcggagaaagaatctgttttggtgctgggttctggtccaattcgtatcggacagggtgtggagtttgactatgcgacggtacattctgtcaaggccattcaggcagctggctacgaggccattattatgaactcaaaccctgaaactgtgtcaactgagttttcggtttcggacaagctttatttcgagccgttgaccttggaagatgttttgaatgtgatcgaccttgagaaaccaaaaggggttatcgttcagttcggtggccagacggctatcaatttggcagagccattggccaaagcaggcattccaatcttggggacacaggtggcggatttggatagagctgaagacagggatttatttgaaaaagccctgaaagacctagggattccacagccaccaggccaaaccgcaaccaacgaagaggaagctcttgaagcggcccgcaaaattggtttcccggtacttgttcgtccatcatatgttttgggcggtcgtgctatggagattgtcgaaaatgaagaggacttacgttcttatatgagaactgcggtcaaggcttcgccagagcacccagttttggtggattcttacatcgtcggtcgtgagtgtgaagtggatgctatttcagatggtaaggatgtcttgattccgggtattatggagcatatcgagcgcgctggggttcactcaggtgactcgatggccgtttatccgccacaaaccttgtccaaagaagtgcaggcgaccattgcagactacaccaaacgcttggcaatcggtctcaactgtatcggtatgatgaatatccagtttatcatcaaggatgaaacggtctatgtgattgaggtcaatcctcgtgccagtcgtacggttccattcttgtccaaagtcacagacattccaatggctcaggttgcaaccaaattgattttgggacaaagccttgcggaacttggctaccaagacggtctttatcctgagagcaaccaagtgcacgtcaaggcaccggtcttctcgttcacgaaactagctaaagttgacagtttgttaggaccagagatgaagtcaaccggtgagattatggggtcagacttgacactggaaaaagcgctttataaggctttcgaggcaagttatcagcacctggctgagtttggcaacgttgtctttaccattgcggatgaagacaaggaagaagtgcttggtctggctcaacgtttctatgaacttggttatggcctactggccacggcaggaacagccacctttctaacagaaaatggacttgctgtaacaactgttggtaaattaggcgatgattcctgtccagatattcctagtcttgttcgggcaggtaaggttcaggctattatcaatacggttggtaaaaaacgggtggcagatggtgacggtcaagtcattcgaagctctgctattgaaggaggaattccgctctttacggccctcgatacagcagaagctatggtcaaagtgctggagagtcgtagcttcatgacacaggctatatagaagatactatcaggatgagctttgaattcgtcctgattttttgatatactgaagagtatgaaaatgattgtaacaactagtcttgggatggatgaggggctggtctatagggctagacggattgccagtgaactgggaattgaatacaaggaaagaaagaagcagtcggttggaaaaatgttaggtacctacgaggctgtcttggttctttataaggataaattgatactagagcagaggggtgggcaggttttatttttccacccagatactgccatgttgcggattaagtctggaagagatccgcttttagaattacttggaaaagaaaaacaatcaataatagactgtactatgggcttgggatctgatagcattgtgttagcaagtgccggtcatcgggtgacagccttggaaagttctaagctagtgcactttattgtgagtcgaggtttacaggattttgatagtgggctgcaagaggtcaatcgagccatgaaatctattcagacaatttggacagatagtttgacttatttgaaagggcaaatagataagtctgttgatgtcatttactttgatcccatgttttcagaagaaatcaaggaatcacaaaatctttctggcttgtctactttggctgacagaagccgtttaacggaggaaattgtatctgaggctaaacgagtagctaggaagaaattgataataaaggctcattttcgagatcaggtctttgaagaatttggctttaaacgtcatgtcagacccaatcaaaaatttcactacggagaaattattttggaggaggaagtatgaaaatcatcgtaacaggctttgatccctttggcggcgagcctattaacccagccttggaaacaatcaaatctctacctaagaccattgctggtgcagagattattcttgtagagattccgactgtttttgacaaggctgcggatgttttagaggagaaaatggcagaacatttacctgatgcggtactatgtattggtcaggctggtgggcgagttgatttaactcctgagcgtatagccattaaccaagatgatgcacgcattccagacaatgaggggcaacagccgattgatagaacgattcgagaagatggtcagcctgcttatttctccaccttacccatcaaagcaatggttgaagctattcataggattgggcttccagcttctgtttctaatactgctgggacctttgtctgcaaccatctcatgtatcaagctctttacttggcggagaaacaatttccaaagactaaggcaggctttctccatattcccttcttgccagagcaggttgtcgacaaaccaggactggcttccatgtctttgaacgatattgtaagaggagttgaagtagctataggagcgattgttgaatatagggataaagaggatattaaaaagggtggtggcagtacacactgatgaaaaatattatggaagcaagaaaacgtgtagaggaaatggaaaaaatatttaacagacagctagagctgaaccagtccctttccgatagtatggcacaactcaaccaggaacaatcgacttatttacagttattagattattaccagagccagacctatatggaagatcttgatttatctaataagggttatttcaatggtattccttgcggagtattgagtgaagatggagtctataatttactgtttgaccgtacaaatctagcaagtcaactgagagaactagcagatatgctcgaacaataaattttttaaaacctgtcaagtttttttcttgacaccctgttaaagtgtggtataatagaacatgtgctaaatagctctgctatttcaccgaataaaaatacaaagaaaagagaacatttaaaaatggcagtaaaaatccgtttgactcgtatgggttctaaaaagaaacctttctaccgtatcaacgttgcagactcacgtgcaccacgtgatggtcgtttcatcgaaactgttggtacttacaacccacttttggctgaaaactcagtaactcttaaagaagagcgtgtacttgagtggttggcaaaaggtgcacaaccatctgatacagttcgtagccttctttcaaacgctggcgtattgaagaaattccacgaacaaaaattctctaagtaagaacagtaagcgagaacacttatggacatgattgaaaatctcattattgcgattgtgaaacctttgatttcacagcctgatagcttgacaataaaaattgttgatacacctgaattcttggaatatcatttggatttggatcaatctgatattggacgtatcattggtagaaaaggacgcacaatttctgcaatcagaacgattgtctattctgttccaacaagtgataaaaaagttcgtttagtgatcgacgagaaagaatagaaagtcaccgtttggtggcttttaacgttgacaaaggggcctagcccctttttaacatatagaaaggaagaaatgatgaatctgatttggacctatttgaaaaaatatcctaagtggattgccttagacttgttgggggccttcttatttgtagtggtaaacttaggcttgccgacttttttggctaggatgattgaccaaggaattacaaagaacgatgttagtcagctctatttctgggcggggatgatgggattgattgtcctgctcgggattgttggtcgagtgacacttgcctatgcagctggaaagttaactacaaatatcgtcaaggatattcgaaatgatctgtatgagaaaattcaggactattctcatcatgaatatgagcagattggtgtttcttctctagttgctcgtatgacaaatgatgcttttgttctcatgcaattctctgaaatggtcttaaaactaggtattattacccccttgatgatgattgcttctgtcatcatgaccttggtaaccagtccgagcttagcctggacagtagcagtagccatgccgtttctagtttttgttattttctatgtggcaacaaaaactcgtcctctctctgaaaaacaacaaaaacgtttggatacgatcaaccaatatgttcgtgaaaatctcatgggcttacgtgtcattcgtgcctttactcgtgaggagtttcaagaggagcgctttgagtcggtcaatgaggaatataccgatatttccaaaaagctctttaatctgactggattgacagagcctctctttgtccagattatcattgctatgattgtggccattgtctggtttgctttggatcccttgaaaacaggcagtctgcaaatcggtgatttggtagcctttatcgaatatagtttccacgcgcttttctctttcttgctctttgctaacttgtttaacatgtatccacgtatgtcggtatcgagccaacggattcaggaagtcttggacatgcccatttccatttctaagaatgaagacggcataactgaaacagatactcgtggttatttggaatttgaaaatgtaacttttgcctaccctggtgaaacggaatcgcctgtgctgcacaatatttccttcaaagctaagcctggtgaaacgattgcctttattggttcaacaggttctggtaagtcttccttggtcaacttgattccacgtttctatgatgtgacacttggtcgtatcttggtggacggtgtggatgtcagacgctacaatctaaaggcactccgcagcaagattggctttattccgcagaaagctctgctatttaccggaactatcgcggaaaacttaaagtacggtaagatggatgctagtcttgcagaacttcatgatgcgacggatgtggctcaggctaaggagtttatcgagagtaaggaagaaaaattcgacacccatctagcagaaggtggaagcaacctgtcaggcgggcaaaagcaacgtttgtccattgcacgtgctattgtcaaacagccggatatttacatttttgatgattctttctcagccttggattataagacggatgcgattttgaggagtcgtttgaaggaagtgacggaaaatgcgacggtgctaattgtggcccaacgtgtcggaaccattatggatgctgaccagattatcgtgctgaacgaaggtgaaatcgttggccgcggcacccacaatgaattgatggaaagcaatgagatttatcgagaaatcgccaattctcagcttaaccgtcaatcgttaacagaagaataggaggaattatgaagaatagatcagtatttacccgtgtttgggactatttgcgtcgttacaaatcttctgtatttttagctgtttttctaaagaccatcagtgcagttatgaatgccttggagccctttgtactggggcttatcattacagaattgaccaagaatctgttggatattgctaatggagtagaaggagcgcagattaactattcctacattgccatcatgcttgccatctatgcccttcgcgcccttctatatgaaatcggtgcctacggttctaactattttatgaccaaggcagtgcagggagcaactaaggaactacgtcaggatttgagtcacaaaattaacaaaattcctgtttcttactttgataagcaccagtatggtgatttactcggacgttttacaagcgatgtggagactgtttcaaacgccctgcaacaaagttttctccagctagtcaatgccgttctgaccctctctctagccattttcatgtgtttctggttggatgtatccctagcacttgtagtcgtaaccttggttccagtgacttattttggttctaagtttgtcatgggcaaatcccagccatatttcaagcagcaggctgatgccctaggtcgtttgaacggctttgtccaagaaaatctgactggttttaacgttctcaaactctacggccgtgaagaaatttctacagaagagtttcgccagattaccgcagatttgcaggaagttggtttcaaggctagtttcatgtctggtttgctcatgcccctggtacacggcttctcaaatatcgcctatgttgtcgtcgccctgctatctggattgaaagttcttgcaggtacattgacggtgggtaatatgcaggccttcgtccaatacgtctggcagatttctcagccagtccaaaccttgacccagttggcaccacagttacagtctgccaaatcttcccttgaacgcatcttttcagtcctagatgagcttgatgaagaagacgccaatgcgctggagttgacagctggtttgaccggacaagtcagctttgaacaggtcgaatttggctattcagaagacaagccgcttatccgtaactttaatcttgatgttaagccaggtgaaatggttgctatcgttggtccaacaggggcaggtaagacaacccttatcaacttgctcatgcgtttctatgatgtcacatcaggtgctatcaaggtagatgggcaggatattcaaaatctttcacgtcaatcctaccgtagtcaatttggtatggtcttgcaggatgcttggctctatgaagggaccatcaaggaaaacctacgttttggacgtctggatgcgacggatgaggaaattgtggaggctgctaaagctgccaacgttgaccactttatccgtaccctgcctggcggttataatatggaaatgaaccaggaatccagcaatatttcccaaggtcagaaacagcttttgaccattgcacgtgccttgttggcggatcctgctattctgattcttgacgaagcgacttcttcagttgatacccgtttggaactcttgattcaaaaggccatgaaacggttgatgaaagggcggacaagtttcgtcatcgctcatcgcttatctaccattcaggaagctgataagattttggtcttgaaagatggacagattatcgaacaaggtaaccatgaaagtcttttggcagacaaaggtttctattataatctttatcaaagccagtttagtgaatccaaataaaaaacgaactcccttgtcagtgacagggagttttctcatatacatgtttgtgaaaattaataggaaatttcggataatagtccctcagcggtagtggttgggaggatgcggacacgattgagagtcagtaatccgtcactagcagaagccaagccgttgttagtagtcacaccaagtttgtagccagcttgttcagttaaggctacggtatctgctgagtatcgtccaccagggtaggcgatagcgatggtttcctgatttaattggctgtcaagataggctttagaggaagtaagttcatttgtttgatcctcgatagaactatactctaaatcagggtggttgacggtatgcccttgaaaggagagccctgcggtctgcatttccttgatttgatcaagagtaaggtgccctgcttgtccatattcagtaaatcctgtaatgacattgttggttgctttcatttgatattgcttaagcaatgggtaggcataactataaaaatcccagaggctatcgtcaaaggttagccagacaacctttttgccagcaggaaggacattttctgtcaataccttataagcctcttcaggtgataaagtatagtaacctgcatcttgcaatgcttttagatgactttcgaaagtcgttggatctacgataagattcgcattagcttcttcctcaggagccattacgtgaatggcatgatacatgaggattggaagtttgataggttcagtttgttgttcccaaatgatttctgtttgtacttcactactttctgaagttataacacttgaagtggttgttgtctctaccgttgaagctttggaatcactttgttgcttagatggctgttttagaaagattagaaaaatagatagtagagtcactactaataatgcgatgccaagtagcattggcacaagttgtttcttttgtgtgcggcttcgacgggctcttcttgaatgtttcattatcttatctccataatcatatattaaaacaattatatcaaattttttgccaaatagtcagaatatttgttataatgggagaaatacattttaaaggagagcacatggtagttaagataggattattaggatttggaaccgttgcgagtggtgtgccatttttattagaagaaaatcaggaaaaaatagagaaagctgcgcatgatagtattgaagttgctaaggttttggtcaaggatgaagcagaaaaagaccgtctcttggctgcaggtcatgactatcattttgtaacaaatattgatgatattttagctgatgaggacattgccatcgtcgttgagctgatgggacgtattgagccagcaaaaacatttattacacatgccttggaagcaggcaagcatattgtaacagccaataaggatttacttgctgttcatggtagcgaattgcgtgccttggctgaagagaaaggtcttgcgctttattatgaagctgcagttgcaggtggtattccaatcttgcgtaccttggttaactcattggctgctgacaaggtgactcgtatcctcggtgtattgaatggtacttcaaacttcatgttgactaagatgattgatgaaggctggacttacgaaaaagctcttcaaacagcacaggaacttggctatgcagaatctgacccaacaaatgacgttgaggggattgatgcagcttacaaggctgttatcctcagtcaatttgctttcgggatgacagttgattttgaacacgtagcacacaagggtatttcgaatatcacaccagaagatgtagcagtggcacaagaattgggctatgtcatcaaacttgtgggtgatattcaagaaactacctctggtattgctgccgaagtatctccaaccttcctaccgaaaaatcatccacttgcaagcgtgaatggtgtgatgaatgctgtatttgtcgaatctatcggcatcggccagtctatgtactatggaccgggtgctgggcaaaaaccgactgcaacaagtgttatggctgacattattcgtatcgttcgtcgcttgaaagacaatactatcggcaaagcttttaacgaatatagccgcccacttcaattggcagccccaagcgatgtgaagagcgaatattatttctcaattgatgcgcctgataaaaatggaaaaatgcttcgtttagcagaaatcttcaattctgaagaaatttccttcaagcaaattctgcaacaagctgcagatggagaaacagcccgcctagtgattgtgacccatgaaatgagtaagactcagttggaaaatgtaacagacaaattgagtaaagaaacagactttactgtcttaaatacctttaaagtactgggagaataagcaatgaaaattattattccagcaacttcagctaatatcggtccaggatttgattcagtaggtgttgccctttcgaaatatctaacgattgaagtatttgaagagactgatgaatgggtgattgagcacaatcttgaacatgttccatcagacaagaacaatcttttgatcaagacagctttaaagattgaaaaaggattgcagccgcatcgtatcagaatgattagtgatattcccttggcacgtggtttgggttcatccagttccgttatcgtagctggtatcgaattggctaatcaattagcaggtttgaatatgacagcggatgaaaaattgctcaaagctacagaaattgaaggacatcctgataatgtagccccagcgattttcggtaatttagtcatctctagctatgttaataagagagtacaggcagttgtaacagaattcccagaagcaagttttgttgcctttattccaaactacccactgcgtacggttgaaagccgaggtgtactgccttctcagatggggtacaagaaagcagtggctgctagtgccattgcaaacgttgctgttgccagtttgatggcaggtgatctggaaaaagctgggaaagcaattcagtcagacatgttccatgaaccgtttcgtcagctacttgttaaggagttttgtccaatcaagcaaactgcacaggagttgggagcctatgcaacctacttatcaggtgccggtccaacagtgatggtattagcgcccaaagatagggaggacgctattgttctagcattagaggaactaaatctagacggaactgtccaccgccttcaagtagataccaaagggattgctattgtatagatagtgagaatctgtcatttgcaaaactaaacatgtttatttattggagttcgccatcgctactgtaagcggtagaaagggaactccttttttttgtgcattccattctccatttcaaaatattggggcaaattaatttggcttgtgaaagtatttttgttgaattttattcgttttctcctgtaatttttggtataataaatcctgtatatcttaaattgaaatgagaaggttatgaaagataaaattaggcttgaattagaaggcatcgatattcgattcgatgaacctttaaaagaatatacctatacaaaagtaggaggagctgttgattatctagcttttccgcggaatcgttacgagattgttcgtatagtagaatttgctaaacgcgaaggtattccatggcaagtattaggaaattcaagtaatatcattgtccgcgatggcggtattcgtggttttgttatccgtatggataaacttaactccgttactgtatcaggatacaccattgaagcagaagcaggtgccaatctgattgaaacaacaaaagtcgcacttttccattcgttatcaggatttgaatttgcttgtggtattccgggaagcattggtggtgctgtctatatgaatgcaggtgcttacggaggtgaagtggcacacattttagtttcagcgcagattttgactcctgcaggttatgtcgagacattggacaatcgtgagttacgatttggctaccgttcttctattttgcaggaaaacggtgcgattgttttgtctgcaaaatttgccctcaggccaggaaatcatacggttattcaacaagaaatggctcgtttgacacatttgcgcgagctcaagcaacctttggaatatccatcttgtggttcagtcttcaagcgtccacttggtcacttcgcaggacagttgattatggatgcgggtttaaaaggttatcgaattggtggagtcgaagtttctgaaaaacacgctggctttatggtcaatatagaaaatggtacagcatctgattacgaaaatttgattgcccatgtgattcaagttgttgaaaaatcttcaggaattactctggagagagaggttcgtattatcggcgatcctgctgatacactctagccatcaggctcttacaaaaaagaaggaatttatgagaattgaaaaagccaattattgaatttaagaacgtttcaaaagtatttgaagacagtggaacaactgtattaaaggatattagttttgaattggaagaggggaaattttatacccttttaggagcttctggttcaggtaaatcaacgattttgaatattattgctggtttattggatgctagttcaggtgatatttatctggacggtcaacggattaatgatgttccgaccaataaacgggatgtccatactgttttccagtcctatgcccttttcccacatatgactgtctttgaaaatgtggcttttcctcttaaattacgaaagattgacaaggctgaaattgaacgccgtgtgacagaagccttacaaatggtccgactttctggttatgaaaatcgttccattcagaaattgtctggtggtcaacgccagcgggttgctattgcacgtgcgattatcaaccagcctcgcgttgtcttgctagatgaaccactttctgccctggacttgaaactaagaacagaaatgcagtacgaactgcgtgaattgcaacaacgtctaggaattaccttcgtcttcgttacccatgaccaagaagaagctctggccatgagtgactggatttttgtcatgaatgaaggtgaaattgttcagtctgggacgccagtggacatttacgacgaaccaatcaaccattttgttgctaccttcatcggtgaatccaatatccttccaggtcgcatgatagaagactatctggttgagtttaacggcaaacgctttgaagctgtcgatggcggtatgcgtcctaatgaagaagttgaagtcgttatccgtccagaagatttgcagattaccctacctgaggaaggcaaattgcaggtaaaagtggatactcagctcttccgaggggttcactatgaaatcatcgcctatgacgacctcggtaatgagtggatgattcactcaactcgtaaggccattgtcggagaagtgattggactaagttttgagccagaagatattcatatcatgcgtctcaatgaaacagaggaagaattcgatgcccgtatcgaagaatatgtggaagtggaagaagtagaagatggcttgattaacgccattgaggaggaacgcaatgaagaaaacctctaggctttttgcaattccctatgccctatgggtctttctatttgtactcgctccagttgccttgattatcttcaaatctttctttgatattcatggcgatttcactttggccaattaccagacctattttaactcgccaaatatgacctatctgcgaatgagttttaactccattttttacgcaggtattattactctggtcacgcttttggtttcctacccaacagcctatttcttgaccaaactcaagcatagacagctctggctcatgttgattatcttgccaacctgggtcaatcttttgctgaaagcctatgcctttatcggtatttttggacaacacggctctatcaaccagttcctagaatttattggtctaggagctcagcaaattcttttcacagatttctcctttattgctgttgcagcctatattgagattccgtttatgattttgccgatctttaacgccttggatgatttggataaaaacctaatcaatgccagtcgtgatttgggggcaactccttggcagaccttcacaaaagttatttttcctctttctatgaatggtgtccgttctggtgtacaggcggttttcattccaagtctgagcctcttcatgttgacccgtttgattggcggcaaccgagtgatcacgcttggtacagctatcgaacaacactttctcacaacacaaaactggggaatgggttcaaccataggtgtggtcttgattttggccatgctcttgattatgtggatgacgaaagagaggaagaaataatgaagaaatttgcaaatatctacttaacagttgcctttctccttctctacttaccgattttctatcttattttttatgcctttaatgaaggcggagatatgaatggctttacaggctttaccttagagcatttttcatctatgcttggcgatagccgactaatgctgattctggctcaaaccttcttgttggccttcttgagttctttgattgcgaccattatcggaactttcggtgccatctatatctatcaggcaaaacctcgttttcaaaatgcactcttgtctgtcaataatatcttgatggtagctccagacgtcatgattggggcgagtttcctaattctctttaccatgattggtttccagcttggctttgtctcagtattgctcagtcatattgcttcttctattccaatcgtagtattgatggtcttgccacggctgaaagagatgaacgcagatatgatttcagcagcttatgatttgggggcaactcagccacaaatgctgaaagaaatcatgttgccatacctaacaccagccatcattgcaggctactttatggcctttacctattccttggatgactttgccgtgacattctttgttacgggaaatggttactcaaacctatctgtagagatttactcacgggctcgtcaagggatttctctagaaatcaatgccttgtcaaccctagttttccttttctctatcttattggtagtgggttattatttcatctcacgtgaaaaggaggccaactaatgaaacgattgtattcattttttgtaggaattatagcaattgtcctagttttatggggaattagttataagttagaagctgattcaacccaagggacaactgataaacttgtcatctataactggggcgattatattgacccagaattactcgcagaattcactgctgaaacaggtattcaggtagattatcagacctttgactccaacgaatcgatgtacacaaagattaagcagggtggaacaacatacgatttgacaatcccatctgagtacatgatttctaagatgacagaagaaaatatgttaatcaagctagataagtctaagattgaagggatagaaaatatcgatccacgatttatgggccttagctttgataagaataatgactattctattccatatttctggggaaccttgggcattgtttacaatgaaaccatggtagaaaatcctcctcaggaatgggaagacttgtggtcagaggaataccgtgacaatatcatgttaattgatggtgtgcgtgaagtcatgggctttggtctacaatcactgggctatagtctcaattctaacaatcctaccgagattgaaaaggcagccgaacatctttataatttaactccaaatgtcaaagcaattgttgctgatgagataaaaggttatatgatacaagatgcggcagcaattgctgtttctttctcaggtgaggcgagtgaaatgttagatggaaatgaaaatctgcgctatgttgtaccatcaaaaggttctaacctgtggtttgataacatggtcattccaaaaacagcaaaaaatattgatggagcttacgcctttatgagttttatgcttcgtcctgaaaatgcgcttcgcaatgcagaatatgttggctactcaacaccaattcctgcagccaaggctatgctggatgaggagactcagaacgacgaatccttctatccttcagaagaaacgatgaagaagatggaagtttatgataatcttggaccagagatgcttggaatgtataatgacctctatctccaattcaagatgtatcggaaatagtctgattggacaggtagcaatataaataaaagaatgggagtgaggttctttactaagtacttattgctcctattttttggtcatgcatactatagaaaggaagggaaatcccaatggaaaatcaccggaaagaagttagttttatttctcaatcaatcctctattcggttctgcgtggtagtttagttggcattgtcgctggtttagtggtcgttgcatttcgcttagccattgaaaaactattttctgtctttacgcacctctattctctggcaacagacaatgcaatctatttacttcttattggagggctttatctggtcatagctttacttgttggcaagttgatcaaagacgagccaaatgcaaaaggttctggtatacctcaggtggaggcagaactaaaaggaattatggatttgaactggtggtcagtcctttggagaaaatttatcggcggtgttttatccattgcatctggtctaatgctggggcgtgaaggtcccagtattcaattaggagctgtaacggctaaaggtgtatcagttcttcttaaatccagtgaaatggaaagaaggagtttgattgctagtggcgctgcggcaggtttggcagcagctttcaatgcaccaatagcaggccttttatttgttgtggaggaagtctatcatcagttttcacgtctggtatgggtctccgccctggcagccagtatcactgcgaactttatttccttacatgtttttggattaatgcctgttttgcatatgccgaaggacttacagttactatctcttgaccaatattggatctatatcttacttggagttttccttggccttgctggatatgtgtatgaaattgttatcctcaatatacaagatttctataccctcctctcaaaaatcattcctctcccagttccatactacagtgtatttgcctttttgtttattataccgattggttattttttccctaatctgttgggtggcgggcatcatttgattttagagcttccatatttggaacaaggactactgacattggcaatcttgattttaatacgatttgtatggagcatgatttcctatggttctggtctaccagggggcatctttttacccatattaaccttaggaagtctccttgggctttttgtcgcacggttcttccttgatattggtttcatcagtcaggagcagatgctattgtttattgtattgggaatggcaggctttttcgcagcgatttccaaagcacctctaactgctattattttagtaactgaaatggttggaagtttgaaccaattgatggtcatcgggttggtagctttgagttcctatgtgatgatggacctcttaggtggcgcgccagtctatgaagcaatgttggaaaaaattctgccagaagaagtagaacagcaagaacacatgaccttaatagaggttgttgtcaacgaaacattggacagaagatttgttagcgagttacgtttgccggattcatgcttgatcaccagtcaaattcatcacggtaagtcaaggattgtgaaaggaaatagccaactttctatgggggattccttgctcgttgcagttccaatctctcaaattcataccgttcgtaggatatttgagggagattagcattttttagattgtcttaacaaagagatgagaaaagtcccaatattatactgttttcgttgtctggtcaactccctcaattcttgaatggtttcatcgggaacgaaactccgaggaagcagaccaatccgtgttaatttggcaatccagtgagcgtccttcttgtcggttttctgacctggaatagccttcatgtgggctggttgagcaagtattagctcgaagtcatcacatagagcatgccagacaagtcgccaatagacacctgtgctttccataccaacagcttctacatgaaattgactgagaaaatcgtggtaagcacgtagacctttagtcgttgtatcaaatgtagctaagtaacgctttggacaagttgaggggaatacaaacgacaatatcgacttgatctacacatgattactatgacaattctttccttcttaaaattagagagcctatctactgaattttagtcatattcttgagcgcatattgtggttcttatcagtagggtggagcagttttgtcatcataattaacatcaataatgcaccaaccacaaggccctcactaggtatataatcttagtgagggctttatgctcattctcattattctgtgggtaaggacggagccatcatggatgtcttactcactccctttttagtgtgtattatctgtatctatggttatagatattattgatagctagttatagtttgaataaataactgaattttcagaatatacttgcaatgctgataattttatgttttaatatatttattggctttgccaataataaaggagaaaaactaggaggaaaagttatgaaaaagaaagaaactttctcacttcggaagtataaaattggaactgtgtctgttcttttgggtgcagtttttttgtttgcaggtgcaccatcggtagctgcagatgaattgacaagccttgtagagactaaggtggaagcaactgttcctgacgtaatcgtcagcgaatcagcctcagaaagtcccgttgtcgaggagttagttgacacttctgtggaggctaccccaactgatgtaaccactacagataatgtagaggaaacacttggctcagaagctcttgaaaacatcacaaatacagaagtagaagcgactcaaccagctgtagaaactccagctatttcagagaaaaaagtagaagaagaggagaagcttgccgtagcagatgagactactgctattactaatcaggaagaagcgaaaccacaaaacattgatagtaatacaatcattacagtacctaaagtttgggatagtggttacaagggcgaaggaacagtagttgcaatcatagattcaggtcttgacgttgaccacgatgtattgcatatttcagatctctcaaccgcaaaatataaatcagaaaaagagatagaagcagctaaagaagcagcaggaattacctacggcgaatggtttaacgataaggttgtatttggttataactatgttgatgtgaatactgtcttgaaagaagaagacaaacgttcacacggtatgcacgtaacgagtattgccacaggaaatccgacacaaccagtcgctggacaattaatgtatggtgtagctcctgaagcgcaagtcatgtttatgcgtgtattctcagacctcaaagctacaacaggcgcagcattgtacgtaaaggcgattgaagatgctgtaaaattaggtgcagatagcatcaacctcagcctgggaggagctaacggctctgttgttaacatgaatgaaaatgtgactgcagcaatcgaggctgctcgtcgtgcaggtgtttctgttgttattgctgctggtaatgatggaacatttggttcaggtcattctaatccgtcagccgattatccagattatggcttggtcggagctccttcaacagctcgcgatgcaatttctgtcgcttcttacaataacacaacggttggcagtaaagtaattaatatcattggcttagaaaataatgctgatttgaattacggtaagagttcgttcgataatccagagaaaagtcctgtatcatttgaaattgggaaggaatatgaatatgtctatgcaggaatcggtcaggcttcggattttgatggtttaaatttgattggaaaacttgcgcttattaaacgaggaaccatcagtttctcagaaaaaatagccaatgcaacagctgcaggggcagtaggggtcgttattttcaatagccgcccaggtgaagccaatgtgagcatgcaactggatgatacagctatcgcaattccatctatcttcattccattggaatttggtgaagctttggcatctaactcatataagattgcgttcaataacgaaacagatattcgccctaacccagaagcaggtcttctttcagatttttcaagttggggtctatcagcggatggcgagctaaaaccagacttagctgctccaggtggtgctatttatgcagccatcaatgataatgactatgccaacatgcagggaacaagtatggcttcaccacacgtagcaggagcagccgtactagtaaaacaatatttacaggcaacttaccctactaagtcccctcaagaaatcgaagccttagtaaaacacttgcttatgtctactgctaaagcacatgtgaacaaagaaacaacagcctacacttcccctcgccaacaaggtgcaggtatcatcgatactgcggcagctatttctacaggtttatatttgactggcgaagacggttatggcagcattaccttgggaaatgttgaggatatattcagctttacggtcacacttcataacattacaaacgaagataagactttaaactactcaacacagttaacaacggatactgttcaaaacggattgattaccttggctccgtgtctattagcagagattcctggcggtaaggtgactgtgaaagccaattcaagtacaactgttacaattaatgtcgatgcagcaagctttgcagaagaattgacaggtttaatgaaaaacggttactatcttgaaggttttgttcgatttacagatgtagccgatgtcggtgatattgtcagcattccatacgttggtttccgtggggaattccaaaatctagccgttctagaagagccgatttacaatcttattgccgatggtaaggggggcttctactttgaacctgttacagcacaaccagatactgttgacatcagccatcactacacaggtcttgttacaggaagtacggagttaatctattctacagacaaacgatctgactttgcgatcaagactctaggtacatttaaaaatgaagcaggatactttgttttagagctcgatgagtctggtaagcctcatttagctatctcgccaaatggggatgacaaccaagattcgctcgctttgaaaggtgtcttcttgagaaattatacggatttagtcgcaagcgtctatgctgcagatgataccgaacgaacaaatccactttgggaaagtcaaccacagtcaggcaataagaacttctatagtggtgatcctaaaaatccaaaatcaagcattatttaccctactgaatggaatgggacagacagcgagggaaatgctttagcagatggtaagtatcaatacgttttgacctactcatctgaagttccaggtgcagcagtacaaactatgattttcgacgttatcattgatagagaatcaccagttatcaccacagctacctatgatgaaacaaactttacatttaaccctcgtccagccattgaaaaaggagaatccggtctatatcgcgagcaagtattctaccttgtagcggatgcaagcggtgtgacaactattccttccttattagaaaatggtgatgtaaccgtttctgataacaaggtatttgtggcacaaaacgacgatggctcctttacattgcctcttgaccttgcagatatttcaaaattctactacacagtagaggattatgctggtaacatcagctatgaaaaagtagagaatctgatcagtatcggcaatgaaaaagggttggtaactgtcaatattcttgataaagatacaaatagtcctgtaccaatacttttctcttactcagtcaccgatgaaacaggcaagattgttgcagaattaccacgagatgccggcgatactagcgttcttaagctaccatttggtacttacacctttgatttattcttatatgatacagaatggtcaagcctagcaggtgaaaccaaagcagtcgtgacgatttcggaagaaaatagcactgccgaggtgaatttctatgtgactttgaaagataaggccaacttgctggtagatattgatgcattactaccttctggttcaaccatccaactggtaactgctgatggccagactattcagctaccaaatgctaaatattctaagaccgattatggtaaatttgtaccagttggtacctacactatccttccaaccctcccagaaggctatgaatttttggaagaattagacgtagcagtacttgcaaaccagtcaaatgttaagaaattaaccttgattaataaagttgctttgaaagaactgattgctgaacttgcgggacttgaagaaacagcgcgttattacaatgctagtccagaacttcaaactgcctatgctaaagcattagaagatgccaatgcagtatatgccaacaaacacaatcaggtacaagtagattcagcacttgccaatcttgtggcagcgagagagcagctaaacggtcaggctaccgataaggaaaaactaattgctgaagtatcaaactacacaccgactcaggcaaactttatttattacaatgctgaaaataccaaacaaattgcctatgatacagctgttcgttcagcacaacttgtattgaaccaagagaatgtaacacaggcagttgtcaaccaagcgttggcggacttgttagcggcgaaagccaacttagatggtcaaaagactgatatttcagcccttcgtagcgcagtatccgtttcttccgtattaaaagcgacagatgctaagtatctcaatgcatctgaaaacgtgaaacaagcttatgaccaggcagttgaagcagcgaaagcgattctagctgatgaatctgcaagccaagcaagtgtcgatcaagctctagccgttctgacaagcgcgcaggcagaactgaatggtattgctacttcaacaaatgatgccaaagagccagcaaatactgccactgacaaaaaagatgaaggcactgtaacgcctccacctatagactcagaaaaagttgatgtacaggcacctcctgtaaaagatactgggaattcagggcatgtatcgatcggtcagaagccaaaccctcaaccaactttacctcgtccagtcactttgcaagctagtctatctagccctaatcaagaaaaacaggtaactcaactaccaaatactggagacaatgatacgagatactatcttgttcttggtgtcattattgggctagggactctgttggtaagcaaacgacgtcataaagaagaagtctaagaaaatatagtcatactcttcgaaaatcaaaattatccgttgtcaacttgccatgatgaactccagttctatcttcggcttcgtttcctaggctacttttgatttgcattgagtatcattttctaccatttgtcaggctttaatcacgagtttgttatataaaagaccgcttaatcattgattaggcggttgtttgtgtttgaaattgaagcattgtcttttggatgtttcttgagacatcagttggctttacaagataataatcttgagccagttggtcggcaatataggagtggaggtaggttgctacaaggattctttcatatagttgaacaaggggaaattgtacagcaaatcctgcaatcatacctgcaagagtatctcccatacctcctgttgcttggtaaggaccaccagctcctattggggtgacttggtttggctgggtttttaggatttgagtagcggaacttttagctacaaggattgtattttcttgaaaagattgcaaggcttcaagatttctttggcttgtttggtcagcaaccggaatggctgataaccgttcccattctttctggtggggtgtcaggatgacttgtttacacgggaagttctttctgttttgctttgcgactaaggtaagggctgagccgtcaagaactaaaatctgctggtcagataaatgttcaaaaacaaagtccaataactgttcagctctgctattttccccaaaacctggaccaatcaataccaagtcagcattttctaagctacttatcagtaaggcttgatcgtcaaatgaaaatgccatggcttcaggcagatgactatgtaaggctggtatgttatctttttcagtagcaacagttaccaagcctgctccactgttgacgcttgctagtgcggccatgataatcgctccaccatagggatacagtccaccaatcagcaagactcgaccatagcttcccttatggctgttgcgtggtcttgcttgaatgacctttctacagagttcttgtaagtccatacatattcccccttttctttttattataccacgaggaatgaggtttatgacaatccagattttagataaatccaagttttcatgctataatgaattcatggtattatcaaaaaaacgtgcaagaaaagttattgaagaaatcatcgctctatatcctgatgctaagcctagcttggactttcgaaatcactttgagttggtatgtgcagtgctcttatctgctcaaactacagatgctgcggtaaataaggcaacacctggtttgttcgcagctttccctacgccccaagccatggcggcagcagaagtgaaggatattgagccttatatttctcgtttgggtttgtaccgaaacaaggcaaagtttttaaaagactgtgcccagcagttgatggaacggcataatggcattgtccctcaaactcgtgaggaattagaagccttggcaggagtgggaagaaaaacggccaatgttgtcttaagtgtcggtttcggaattcccgcctttgcagttgatacccacgtgggacggatttgtaaacaccacgatattgtcaaaaaatcagctacacccctggaaacagaaaaacgagtcatggaagtcttacctcctgaactctggctccctgctcatcaagctatgatttattttggtcgtgaggtttgccatcctaagaaccctgaatgcgaaaaattcccacaattatatgaatttgactaaaaaatcttctgtttttgaagatttttttagtttttatgtaaaattgtttgagtaaattctgaacatttttttaaattttataagaataataactcagaaaagaattatacgaatgttatattttataaacaagcctaaaaagtgatatatccgaatattgtttatataggtttcttttttattgacaaaacacaaacaataagctatactatatcttgtaataaggaaaaaatacgaaaaacaaaccgtttttctgttccaatgttaagaaaaagaggtagaagcatgttcaacgaaactccagtttttgactacgaagatattcagctcattccaaataaatgtatcatcaatagccgttccgaggcagatacaacagtgactcttgggaaatatagctttaaattaccagttgttccagctaatatgcagactattattgatgaagatgtggcagaaatgcttgccaaagatggttatttctacatcatgcatcgtttcgatgaagctggtcgtattccatttatcaaacgcatgcacgagcaaggtttgattgcttctatctctgttggtgtaaaagaatatgaatatgagtttgtgactagcttgaaagctgatgcccctgagtttatcaccattgatattgctcatggccatgcagaaagtgttatcaagatgattcaacatatcaagaaagaactgcctgagacatttgttattgcaggtaatgtcggtactccagaagcagttcgtgaactagaaaatgctggtgcagatgcgacaaaagttggtattggtccaggtaaagtatgtattacaaaggttaagactggttttggtacaggtggttggcagttggctgcccttcgttggtgcgcaaaagctgcccgcaaaccaattattgcggacggtggtattcgtacccacggagatattgccaaatccatccgcttcggtgcaagcatggtcatgattggttcgctctttgccggtcacattgaaagcccaggtaaaacaattgaagttgatggtgagaaattcaaagagtactacggttcagcatctgaataccaaaaaggtgcttataaaaacgtagaaggtaagaaaatcttactccctgccaaaggacatttaaaagatactctggttgaaatggagcaagatttgcagtcatctatttcttatgcaggaggacgtgacattaccagcttgaagcatgtggactatgttatcgtgaaaaactctatctggaatggtgactctatctagtcaaagaggacttgcaatgcaggtccttttcttgttacaatatttatataaaattgaaagagaataagtatgtaccaaacaagaaataacaaagagaagctctggctctttatcaaaatatttttgcccattttaatttaccaatttgctaattactccgcatcctttatcgataccatgatgactggtcagtatagtactatggatttggcaggtgtttccatggcaacaagtctttggaatccgcttttttcatttcttacagggattgtatctgcattggtctcgattattgcccaatatttgggacaaggagagaagtcaaagattcgacaagagtttcatcagtttgtctatctatctattggattaaccattttactcttgtgctcgatcctatttatcgctgttcccgtcttggctcagtttggacttgatgaatctgtttttcaagttggtcggcagtacctctattttatttccattggtatcctgcctctcttgctctttagtgtctgtcgctcttttttcgacgccctcggcttgactcagctatccatgtacctcatgttgctccttgtcccatttaacagtctatttaactatctcttaatttatgggaaaatgggcctcccggccctaggcggagctggagctggattgggtactgctttagcttactgggcggtattgctagtaatcgttattgtcatgtgcaaaaataagactatttcttcttatcagatttggcggtggagtccgattgatgggtctttactgaaagaaggactgaaaatcggtcttcccatcggtttacaagtctttgcagaagtagcaatttttgcagtagtagggctctacatggcaaaattttcagcacagattatagcagcccaccagtcagctatgaactttgcaaccttattatatgcctttccatatcggtatcctcagccctagctattgtcattgcttatgaagtaggcgctaaacgaccacaagatgtgaaagcctacagccgtctgggacgcttagtagcactaggctttgcaggtttgacgctaactttcctatattttttccgctccaaagttgcctacctttatggtaatgacgcagaatttatccgtctgacctcgcatttcctgagctttgccctcatgttccagttagcagatgcctttacagcacctattcaggggattttacgtggttacaaggatacgactgttccatttatacttggtttggttgcctattggtccatgaccttcccagtcgcattcttgcttgaaagatttttccaaatgggtccagaagcctattggatcggtcttatttcagggatttttgtctgcggaatagctctcaatttgcgcttgatcaaaatagctcattctcatttgtctgtgaaataaattaactatgaaagtcggaggcatccggctttttctctcttgtgaaaatatcttgctcatgttaaaataaaaggatagaaaatcaaatggagaaattatgaattattttaacgtaggaaagattgttaacacgcaaggcctacaaggggaaatgcgtgttttgtctgtgaccgattttgctgaagaacgttttaaaaaaggggcaaagcttgcactttttgatgacaaggatcagtttgccatggaagtggaaattgctagtcaccgtaaggctaagaactttgatattattaagtttaagggcatgtaccatatcaacgatattgaaaagtacaagggctttagtttgaaaattgccgaggaaaatttgaccgaccttgaagatggtgagttttattaccatgaaattatcggcttagatgtctatgagaatgatattctgatcggacaaatcaaggaaatcttgcagccaggtgccaatgatgtctgggtggtgaaacgaaaaggtaagaaagacctgctcttgccatatattccacctgttgtcttgaacattgatattccaaataaccgtgtcgatgtggaattgctcgagggcctagacgatgagaattgatattttgaccctcttccctgagatgtttgcacctctagaacactctattgtgggtaaggcgcgtgacaagggtttgctagaaatcaactaccacaatttccgagagaatgctgaaaaggctcgccatgtagacgatgaaccctatggcggaggacaaggtatgttgctccttgcccagccgatttttgataccatggatagcattgaacaaaccaagccacgtgttatcctattggatcccgctgggcgtactttcaatcaggcctatgccgaagaattggcacaggaagagcagctgattttcatttgcggtcactatgaaggatatgatgagcggattaagaccttagtaacagatgaaatttctctcggagattatgtcctgacaggtggagagttggcagctatgaccatgattgatgctaccgttcgcctgattccagaggttattggcaaggaagtcagtcatacggatgatagtttttcatcagggctattggaatatcctcaatacacccgaccatacgagtatcgtggaatggtagttccagatgtattaatgagcggtcaccatgaaaatattcgtaaatggcgtttggaagagagtctacgcaaaacctatcaacgtcgtccagacttgttagaaaactacaactttacagctgaagagttaactatttttgaaaaaatcaaagcagaagacacagttgattagactgtgtttttcttgctagaaggagaaatgatgaaacgcaaggtatttgaacattaccaaccttataaaatcaaacaaaaggcaagatttgatttaggaaataacgaaaatcgtatcattgattgggcttttttgccacaagagactttggaaaatttggatgtcaatcaattaagtttttatggtgataacacttactccgaactgattgagaaatatgcgacctatcttggagttaatcccaaacaagtgacggtaggtgtgggctctgatcaccttattcacatgattgtttccacctttatggaaaaggatgatacttttttgactgtcaatccagacttcttcatgtatgaaacctataatcacatgcatggtagccgttttgaagccattgatttagaagaaaaaaacgatacactcgtcctgccagtagagaaattgttggcgcgtgcggaggaggtgaaggcaaagataatcatgctttccaatcctaacaatccttcttcagtagcttattcactagaagatttggagaaattggctatttcttttaaagggctactcgttgtagatgaggcttacattgaatttgcaaatgtcgaaagcttcatcagtcgtctgcaacaatttgacaatgttttagttttacggactttatcaaaggcttttggacttgcaggtttacgagttggctttgcggtaggaagcgaagagttaatttatgaattggacaaggtcattcccccattcagcttgtcaaacttgactgcaaaaatggcagccgttgcattgaattatacagataaggttttagaaacagtggaagtaattcagaatttgcgagaagaaatgattttattcttgcaagggttagataactgtcaagttctacctagtcaggctagttttgtaacgtttaaagcaacgtgggcagaagaattttatcagcaagccttggcacaggattggaatttcaaatattatccaacaggtaaattagaagggcatattcgcctgtctatcggccgtccagaagaaatggacatgatgaaaaaaatgattgagaaactagtggaagcgtaaattctgctagtttttttgttttttgaaagaaaatgatagaaaatgattgacaatggcagaaaatcgtgtataatgatttttgtaaacggttgcaggaggtgttgaacatactcaaatcagaacgaaaacagattatattagagcgaatacactctcaacagtttgttcggctagaggaattaatcgaagttcttgatacatctgagtctactgtacgtagggatttggatgagttggaaaacgaaggtaagcttcgtcgtgtacacggcggtgctgaagcgccagggaatttgcaactcgaagagtctattctagaaaaatctgtcaaaaacgttcaagaaaaacgagagattgcggaaagtgctgctcgacaaattgttaacggagacgtaatttttttagatgcaggtacaacaaccggtgtactgattgattatcttcagcaggaaaatctgacagtcgttaccaattctattcaccacgcagtgaggctggttgaacgcaagataaaaacaatcattataggtggttttgttaagcaatcaacagatgcttccgttggagcagtagcattggaacaaattcgacagctcaattttgataaagcatttctggggatgaatggtattgataaaaactattttacaacgccagatattgaagaagcgaccatcaaatgcactatcatagacaatgccaaagaaagctatgttttggcagatgcttctaaaattggtcaattctcctttgttaaagttgcggcaatcgaaaaatccaacattatctgccaatcttcagaaagcagtttgttggacatcataaaagagaaaacgagggtaatcgaggtatgatttatacagttacgctcaatccagcgattgactatatcgttcgtttagaagatgtcgagacgggcagtgtcaatcgtatggagagcgacgataagtatgccggcggtaagggaattaacgttagccgtgttttgaagcgcttgggctatccgaatacagcaacgggtttccttgggggattcacaggtcagttcatcaaagatggattgattgccgaaggaattgatactgattttgttcaggttgatcaagatacacgtattaacgtgaaaatcaaagctgaccaagaaacagaaatcaacggtttgggtccgattgtgacagatacacagttggccgaattagaaatggtcttagcaggattgaccaaagaagacaccgttgtctttgctgggtctgctccagctagtcttggaaacgaagtctacaataggctgattcctgtggcgaaaaaagcaggagcgcaagttgtctgtgactttgaaggtcaaacactcctagactcactagcacaccagccacttttggtcaagccaaacaaccatgaacttgaagcaatcttcaacgtcgaattgaatggcattgcagacattgaaacctacgctaagaaaatcttagaaatgggtgctcagaatgtgatcatttccatggcaggggatggggctttgttggtcactccaccagctacttactttgctaaaccaatcaagggtacagtgaaaaactctgtcggagctggagattccatggtggcaggttttacaggtgaatacgttcgctcacaagacccaattgaagccctaaaatggggagttgcttgcggtacggcaacagccttttcagatgatttggcaagtatcgaatttattaaggaaacttatgaaaaagttgaggtagaaacactatgaaaattcaagacgttttgagaaaagatgtcatgttgcttgatttgcaagcgacaagcaaggaagcagttatcgatgaaatgattgctagtttggttgataaaggatatgttacagattttgatgttttcaaaacaggtatcatgaaccgtgaagcgcaaacaactactggtcttggcgacggtatcgcaatgccacatgctaagaatgcggctgtaaaagaggcaactgttctctttgcaaaatcaaacaagggagttgactacgcaagtcttgatggtcaaccaaccgatttgttcttcatgattgcagctccagaaggtgcaaacgatacacacttggctgcccttgctgaattgtctaaatacttgatgaagcctggatttgctgacaaacttcgtggtgtgtctagcccagaagaagtcatttcagtttttgacgcagctgaagcagcagataagactgctgaagaagttgttgcagcaccaagtggtgaccgtccatttatcgttgctgtgacagcatgtacaacaggtatcgcccacacttacatggcagaagaagcacttaagaaacaagctgctgagatgggtgttgacatcaaggttgaaaccaacggtgcttcaggtgttggaaacaaactaaccgctgaagacattaagaatgcagcaggtgttatcatcgcagcagataaggctgttgatatgcctcgcttcaatggcaaacctttggtatctcgtccagttgcagctggaatcaaacaaccagaagaattaattaaccttatcttggatggtaaagcatcagcctacactgcgtcagaaggagcagctactgtggaatcttcagaaaaactcagtcttggcaaagcgttctataaacacttgatgagtggtgtgtctcaaatgttgccattcgttatcggtggcggtatcttgattgcccttgccttcctattcgatggagctctaggtgtgccacaagacagccttggtagtcttggttcataccatgaaatcgcagctatgttcatgaagattggtggagcagccttcggcttcatgttgccacttctagcaggttatattgcttactcgattgctgaaaaaccaggtttggttgcaggtttcgtagctggtgcaattgctagtagcggtcttgcgttcggtaaaattccttacgcagctggtggtgaagaaacgcttgctcttgcaggtgtatcatctggtttcttgggtgcccttgttggtggtttccttgctggtggtgtagtgctcgttcttcgcaacgctttgcgcaaccttccaaaatcacttcaaggtttgaacgctatcttgctcttgccacttttgggaacagcaatcactggtttcttgatgttcttcgttaacatcccaatggcagcaatcaacacaggtatgaacaacttccttgcaggtcttgaaggtagctctgctattctccttggacttgtcctcggtggaatgatggcagtcgatatgggtggtccagtcaacaaggcagcttatgtcttcggtacaggtacacttgcagcaactgttgcagatggtggttctgttgccatggcagcggtaatggcaggtggtatggttccaccgttggcagtattcgttgcaacccttcttttcaaagacaaattcacacaagaagagcgtaactcaggtttgacaaacattgttatgggtctttcattcatcactgaaggtgcgattccatttggtgctgctgacccagctcgtgcaatcccaagctttatcgctggttctgcccttgcaggtgccttggttggtttgtcaggcatccaattgatggctcctcacggtggtatcttcgttatcgctttgacatctaatccattgctttacatcgcctatgttttgattggtgcggttgtatcaggtgtcctttacggagcacttcgtaaagctaaataattttgattgaaaccttgcttctggcaaggttttttagctatttcacgaggattatggtataatgtgagtattattgttattagaggagtcttgaaatggaaatcattcgcgataaagaatttgtcaatcagtatcattttgatgcccgcaatcacgcgtgggaaaaagagaacggaattccggaaacaaaattgaaagttgactttcaattgattgagcaaaatcgtgcagaaaatcgaacatctatgattaccattttgcgctttatgattgtactagatcattttgtgatttcaggtgccatgagtcaggccgttcacttaccaaatcgattggtagaagagccaactgaatttactgatgaggaaaaacgtgttttggtagagcctcttttggacattttaaaacgaatgacttatgaggttactgaaatcgcctttgatgcaccaggagtgaatttggagttttaatatgaaattagcggttataactgactcatcggctgttttgaatgttcaaagtattgagcgggatgacctgtttgtcctaagtattccagtcagcatcgatggggaaaattatatcgaaggacaaaatttgacggttgaagagttttatcaaaaaatggcttcatcgaaagaattacctaaaacaagtcaaccgagtttgatggaactagaagaaattctggctaaattaacagagaaaggctatacacacgcacttggcttattcttgtcatcaggtatttcaggtttttatcaaaatattcaatatttggctgatgaatttgaaggattaaccgttgcctttccagataccaaaatcacatcggctcctttaggtatgatggtcgaaaatgttctcaaatgggctgatgcaggacttagttttgaagagattactgggaaattggaccaagaaattgggaagactacagccttcatcatggttgatgacctcaatcatttggtaaaaggtggtcgcttgtccaatggtgcagccttgcttggcaatcttttgagcatcaaaccgattctgtattttacaggtgagggtaagatagaagtgtatgaaaaagttcggacggagaagaaggccattaaacgcctcttggaaatcctccaagaacaaacgaccgaaggacagtatcagattgctatcatacacgccaacgcacctcagaaggctgaaaactttaaacggcagttggaagaagcaggtgtcggtagcgatttaccaatcgtgtcatttggttcggtcatcggtacgcacttgggagaaggggcagtggcctttggtatttctcccattattgaataggagtttgcatgacaattaaggtaattatcgcaggattcaaaggaaaaatgggctcaacggctgttgagatggtcaaaggtgacgcagcacttagtctggctgccttggtagatccatttgcgacagaaacagaagtagacggtgttcctgttttcaagaccaaagaagaagttgccagtctggaagctgatgtctgggtggattttacaacgccaaaatttacctatgaaaacacccgttttgccttggaaaatggtttcgcacctgtggttggaacgacaggatttacccctgaagaaatcgaggaattgacagccttgtcagctgagaagggcttggggggcttgattgctcctaactttgctattggcgctatcttgctcatgcaatttgcagcacaggcagccaagtatttcccaaatcttgaaatcattgaattacaccacgataagaagaaggatgcaccgagtggtacggctgtcaaaacggccgaactcatttcacaagtccgtcagtcacagactcaaggtgcagcggatgaagaagaactgattgctggcgctcgcggtgcagcatttgacggtttccgtatccactcagtacgcttgccaggccttgttgcccatcaggaagtgatttttggggcacagggcgagggattgaccattcgtcatgactcttacgatcgtatttcctttatgggcggtgtcaatctcggcattaaagaggtagtcaaacgctcacaactcgtttatggtttggaacacttattatgaaattaaacaatctgccttctgagtttcaggaggctttgccgattttagagaaaattaaagcagctggcttcgaggcttactttgttggtggctccgtgcgggatgccattttaggcagacctattcacgatgtcgatattgcgacatccagctaccctcaggaaacgaaacaaatcttttcacggactattgatgtcggaattgaacacggtacggtgctagtattagaggggaaaaaggagtatgaaatcacgacttttcggacagaggaggagtatgtcgacttccgtaggccgagccaggtttcctttgtgcgttccttagaagaggatctcaaacgtcgcgacttcacagtcaatgcctttgccctggatgaagaggctcaaattgtagacctctttgatgggatgactgacttagaaaaccgcaccctacgggctgtaggcatcccggctgagcgtttcaacgaagatgccctccgtatcatgcgaggttttcgctttgcagcgaccttggactttgagattgaaccgacgacctttgaagctatggtgcaaaccgcaccgctcttggaaaaaatctcggtggaacgtagctttatcgagtttgataaactattgatggcggatttttggcgaaaaggcttgcgcgctatgattgattccaaggcttacaatttcttgcctgatttagctggaaaaagtgatgaattagaggccatgctaacaagtctgacagaagagtttcgcttttcgacatctgaacaagcttgggccctgctctttgtctgcctaggtattgataacatcaagtccttcctgaaaaaatggaaaaccagcaatgatttccaacgcagcgtggtcaagttggtagagatttatcagctccgccaagcaggacctgttaccaagcaaatctgtttcaagtatggcaaagaattcttatacttggtagaggaacttcatcaggcacaaggttttgttacagattttgcagcaatcgataagattgaccaagccttgactatccacgacaagcatgaaattgttgtcaatggaggacatctgatgaaggcatttgacctcaaaccaggtccagtattgggagaactactcaaagaggtggaattccagattgtggaaggacagctggaaaacgaagagcaagcgattatgacatttgtgaaaggaatcttagagaatgagtgattttatcgttgaacacctgactaaatctgtcggagataaaacggtctttgctgatctatctttcatcatccatcaaggcgaccgtatcgggattattggggtcaatggtacaggaaagacgactttgttggatgttctgtcaagtcgtatcggttttgacggagatgtatcaccttttcgtaccaaaaatgcttataaaatcgcctatctgacccaggaacctgattttgatgaaagcaagacagttttagacaccgttctttcatctgacctccgtgaaacccagctgattcgtgaatacgagctgctcttatctcattacgatgaaaccagtcaagcaagactggaaaaggtgatggctgagatggattctctcaatgcttgggagattgaaagccaggtcaagactgtcttgtcgaaactcgggctaacagacctcaacaaaaccgttgctgagttatcagggggtctacgtagacgagtccaattggcccaagtcctccttggcaatgctgacttgctcttgctggatgaaccgactaaccacctggacattgataccattgagtggttgacgactttcttgaaaaatactaaaaagtctgttctctttattacccacgatcgctatttcttggacaatgtggcgacacggatttttgaattggaccgcgccagcttaaccgaatatcagggaaattaccaggactatgttcgcttgaaggcagaacaggacgagcgagatgccgcccttcgccataagaaagagcggctctacaaacaagagctggcttggatgcgcagacaacctcaagctcgtgcaaccaagcagcaggctcgtatcaatcgtttccatgacctcaaaggcgatttagccaacaagatagacgatagcgaattggaaatcaattttgaaacctctcgtatcggtaaaaaggtcattaactttgaaaatgtcagcttttcctatcctgataagcccattttaaaagactttaacctgctcattcaaaacaaggaccgcatcggtattgttggtgataatggaaaaggaaaatctaccctgctcaatctaatcgcaggcgacttacaagcagacagcggtaaggtagatattggtgaaaccatccgtatcggttatttttctcagaccatcaagggcttggacgaaagcaagcgggtcatcaatttcttgcaggaagtggcagaagaagctaagacgacatctggtatggtttctatcgcagaactcttggagcaattcctcttcccacgtaatacccatggtaccctgattgagaaattgtcaggtggggagaagaagcgactttatttgctgaagattctcttgcaacggcccaatgttctcttactagatgaaccgaccaacgacttggacatagcgactctgacagtcttggaacatttcttgcagggctttactggtccagtcattaccgttagtcacgaccgttatttcctagacaaggtagccaataaaatcttggctttcgaagatagcggtatagagactttctttggcaactacacagactatctggatgagaaggcctttctggcttccagctctgccatttccttggaaaaaccaaaggagaaaaccgagaaaatcaaagagaacaagaagcggatgtcctactttgagaagcaggaatgggcaaccatcgaagaggatattgctggcttggaggagcggattgcggcaatcgaggcggaaatgctgacctgtggtagtgattttacaaaattgtccgatttgcagaaggaattggatgagaaaaacgacctgctcttggaaaaatatgagcggtatgagtatctgagcaaactggagggctagatgaaagttcttgtcatgtcatatatggtcatctatctcttggtgaccttaggagcggctttgtttagctatctaaagaccaaaaaaatgaatacattgcgcttgattttaactatcctatccatgatattgctgacaagcaccttgtatttttatagtcagtcttatcacgacttgcagatggtggggtttgctctgggatttacctttatttctactctttttctctataatggaacgaaagaaggtagtaattttacgacagttatgctcttttccattggaaggtttatcttacatattcaatttttaattttgctctatctttttcgatagagcaattaatttttatccgtacaaatttttgaaaaggctttacgcaaacctttgcattgtgttataataaagaaaatacatttgaggtgatgattatgtctaaaaaaattatcggtattgaccttgggggaacttctgttaaattggccattttgactactgagggagaaattcaagaaaaatggtctatcaagacaaatattttagatgatggaagtcatattgttcctgatattattgacagtatcaagcagcgatttgaaacccatggtttgacaaaggacgatttcttaggaattggtatgggctcacccggtgtagtggatagtgaagctggcactgttatcggagcctataacctcaactggaagaccttgcaattggtcaaagagcagtttgaatctgcgctcggtttaccattctttattgacaatgatgcaaacgtagcggccctcggtgaacaatgggttggtgctggaaacaacaatccaaacgttgtctttatgacgcttggtacaggtgtcggtggcggtgtcatcgctgctggaaacttgattcgtggtgtcaaaggtgctggtggcgaattgggccatatcacagttgactttgatgagccatttgcatgtacttgtggtaagaaaggttgtctagaaacagttgcttcagcgacaggtattgtcaacctcagccgtcgctatgctgatcaatacgcaggcgatgcaaaactgaaacaaatgattgatgatgggcaagatgtaacggctaaagatgtctttgatttggcaaaagagggcgatgatttggctttgattgtctaccgtcacttctcagaatacttaggtgttgcttgtgcaaacattgctgcagtcctcaatcctgcctacatcgttcttggtggtggtgtatcagctgcgggagagttcttattggatggcgttcgcaaggtctttgctgaaaatagcttcccacaaatcaaggaaagtacacaaattgtcttggcaacacgtggtaatgatgcaggtgtattgggcgcagcatcactcgtcttgaaataatcgttaaaagcaggggaaactctgcttttttcaattccgctgtcacattttctttatatacatatattgaaaaatgtagtatttaagcatacaatgaaagtgtaaagagaaaggagtgtcaccttatgaaacaggtaaacatgtctaaaataatcaactatctgaccattcttggtttattgattttgttatctgcttttttccttgataactggattcgtgactggtttttcccgtctagctggggaaacgtagcaaccatgttgattctccctctactgggggctctaattcttatactatctatctattataaaaaattgtggactggtttgattagtatcttcttaataatctcatttcctctgatattcggtattggctactttatatttggcccctagaaggagtggttatgaacctgactttactaaaaagattaaatctagttttgtatggtatcgcaatttttctcttcgtcatgctatttttgccaataggacaatggtttgatattgtaaatgtgaattttaaactaacattttttatcattccatttttcggactagccagcttaccaacggctatttacactaaaaatgttcgtcagatattgttgagtgttctcttggttgccttgtattttatattgttcagcctaataactgccctatctggtttgttccaccttaatttttattcattctttttcaaatgagaactccggtgcaaaactggagttttttgctagaatttgctatactaagaccatgactaaagcagatattatttttaaagaaaacattcgtaagattatggaagagggcgttttttcagaaaatgctcgcccacgttacaaggatggaaatgtagctaattccaagtacgttacaggcgcctttgctgagtatgacttgtctaagggcgagtttcctattacaacacttagacctattccaattaagtcggccatcaaggaaattctctggatttaccaagaccagactaatgacctgtctgtcttacaggaaaaatacggtgtccagtattggaatgactgggaagttgaaggaacaggcacaatcggtgaacgctatggggctatcgtgaaaaagcatgacatcatttcaaaaatcctcaagcaattagaggaaaatccatggaaccgccgtaatgtgatttctttgtgggattatgaagcatttgaccaatccgcgggtcttttgccatgtgcctttcagaccctgtttgacgttcggcgagtggatggggagatttatctggatgcaactctaactcaacggtcaaatgatatgttggtagcccatcatatcaacgctatgcagtatgtagcccttcagatgatgatcgctaaacattttggctggaaggttgggaagtttttctatttcatcaacaatcttcacatctatgacaatcagtttgaacaggctgaagaattactccgtcgcacaccatctgaagttgagccacgtttggtcttaaatgttcctgacggtaccaatttctttgatattcgggcagaagattttgaattggtggactacaatccagttaaaccgcagttaaaattcgatttagcaatttaactggattagcagtgaagaacttcgttcttgctatttccaaccttcaacagtctatactcagactttcgaagccagttaaaccgcaacttaattttgacttagcgatttaagatgaggggggctttccagcaccagcgagattcacattctacgaatctcggaatcttccctatctctgaggagtcggtgatagtttcaacatgataaaaatttgcgcttggcctacttggtaagtgcatttttcatgtttttttgatagaatgataggacggaaagtgagagaaaatgactaaaaagattgttgccatttgggctcaagatgaaaatggattgattggaaaaggtgatagacttccttggtcattgccagctgacttagctcatttcaaaaaaacgacaacaggtcacacgatggtgatgggacgtataactttcgacggcatgggtaaacgtgctcttcccaatcgtcacaccatcgttttgacaacggataaaacctatcaactagagagtgaacgtattaccattttacacagtgtggaagatgttctagattggtataacaaacaggagcagacactatttgtgattggtgggggacaaatttttactgcttttgcaccttacattgaaacattaatagtgacagatattcacggtcaatttaatggcgatgtgtattttccgaaagcatttcctatggagaaatttcagctacaaagcgccaatttacgtccaaaagacgagaaaaacccgtatgattttacaataaaaacctatgaaagaagagatggttaggcatggagagaagtttattcggtttatttacagcatttctctgtgggatttgtgttctttgtgcgattcaagcctttcggaagaaacgttttggtttagcaattttatttttactgaatgcttttaccaatctggtcaatagtattcacgccatttatggatttttatttagataagagatatgaaagaggaaacacatggctgttaagcatacacatgagctaatctattgctcattttgcggaaaaaatcaagaagaagttaaaaaaattatcgcagggaacaatgtcttcatttgtaatgagtgcgtggaactagcacaggaaatcattcgtgaggaactggcagaagaagttttgacagacttggccgatacgccaaagccacaagaattactcaatatcctgaacaactacgtcatcggacaggatcgtgcaaaacgtgctttagcagtagccgtttacaaccactacaaacgtatcaatttccaagatagccgtgatgagaacgatgttgatttgcaaaaatcaaatatcctcatgattggcccgactggttcaggaaaaaccttcctagctcagaccttggctaaaagtttgaatgtcccgtttgctattgctgatgcgaccgctcttactgaggcaggttatgttggtgaagacgtagaaaatatcctcctcaaacttttgcaggctgcagactttaacatcgaccgtgcagaaagaggaattatctatgtagatgaaattgataagattgccaaaaaaggtgaaaatgtgtccattacccgcgatgtatctggtgaaggtgtccagcaagctctcctaaaaattatcgagggaactgtggccagcgtaccaccacaaggcggacgtaaacatccaaaccaagaaatgattcacgtggacaccaaaaatatcctgtttatcgttggcggtgcatttgatggtatcgaagaaatcgtcaaacagcgtctcggtgaaaaaatcatcggttttggtcataataatcgtgctattgatgaaaaagaatcatacatgcaacatatcattgcagacgatattcaaaaattcggtatcattccagagttgattggtcgcttgcctgtattcgcagctttggaccaattgacaacagaggatttggtacgcattttgacggaaccgaagaatgctcttgtaaaacaataccagacactcttgtcttatgatgacgtggagcttgactttgatgaggacgccttgttagcaattgcagaaaaagcaattgaacgtaaaactggtgctcgtggacttcgctctatcattgaagaaacgatgttggatgtcatgtttgaggtgccaggtcaagataacgttaaacgcgttcgtgtaacaaaagcagcagtagacggtaaagaaaagcctttactagaaactgcataaaaaaataaagggtggaaactgattgttttctacccttatttatgaaaggtataaaatggaaatcaacacacataatgctgagattttgctcagtgctgtttcaaaagcccagtatccgggctatgacattccagaaattgcccttgccgggcgatctaacgttggaaagtcctcatttatcaatactcttctaggaagaaaaaatcttgcacgtacgtcaggaaaaccaggaaagactcaacaactcaatttttataatatagatgataaaattcgatttgtagatgttccaggttatggctatgctaaagtatccaaaacggagcgcgctaagtggggcaaaatgattgaagagtatttgacgacacgagaaaatctacgtgttgtggtgagtttagtagacatgcgtcatgagccatcagcagatgatgttcaaatgtatgatttcttgaaatattatgaaattcctgttattattgtggcaacgaaggctgataaaatcccacgaggaaagtggaataagcacgaatcgatgattaaaaagaaattggattttgataaaaatgatcaattcgttatcttttcttctgagactcgtcacggatacgatcaggcatgggatgctatcttaagtaacatctaataaacagttcaggagaaaaatcatggaacgtactttcttcatcatcaaaccagatgctcttaagcgtggacttgcaggacaaattctttcacgtatcgaacgcaggggatttcaaatccgagatttaaaaatggttacagcgacagaagagctaatcagtcaacattatgaacagttgacagataaacctttcttcccgcaattagtacaatatatgacgagcgggccgatgatagctggcattatagaagggccagaaattatcaaatcttggcgagatatgatgggagctaccaatccagtaaacgccctacctgggactattcgtggagattttgcgacagcgcccgttgagggaattgtggcaaatgtcgttcatggctcagatagtgcagaagcagccgaacgcgagatcggtctttggctgggaaaatagcagagcagacacctagttttctaggtgtttttctttgataaattggtgaaaaaactgattagtggtataatgaaaaaaagcaataatagagaggttattcaccatggggcaaggaacaacgattagtcttatcaaagaagaaattattcaacaggaaaagcaaattgaaggtatatttttggagattgagaacttgcggattatgaagaagcagtgtaaaaattggttgttttttgctataacgatgctgttcttctctgtcattgtattcaaagggatgtttcttgttattatggtatttctttgtttcatgtatgtagtaacatcatatttccaatcggatagatgtgatggattaattagccattataaaaatgagattgattctatagaggaggctatcaataaaaatagagaattcattgctaagtacaaatatttttcgcatttttatgtagcaggtacgcaatatagggaagatcgttttgagccaatgagggtgttaagatgtctgacgtacggcggagaaactacagatgtcaagttagttcgtgagccagataataagtatgacccaaatgcagttaaagtacttgtatgtggttattttgttggctatatccctaaaactgcttctgaggaagtttcccgactaatcgatagaggggaaaagttgaacttgtcagtagatatggaaagacaagggagttatgataaaggttatcgtgcttattacgaactgacaatttacgttttaaatgatgaaaaattgtaattattaaattcattaaaaatatatcgagtttatgtgggacaagtaataaaatcagaaattaactctttgatatattaactggaatttatatatcgaaaattaatggctccatacctttaatcaaacaataattccttgtttcagtcttattttatgaccgactagaacttactttgggaatttactcgtaacaataacctatatttctaggtgtttttcttatggaaaattatcactaaatctgatataatgaggagtaatacccttgtagaggaagaaacatgaatttagaagatttgaaaaaacgacaggagaaaattcgtaatttctccattattgcccacatcgaccatggtaaatcaaccttggctgaccgtattcttgagaagacggaaacagtttccagccgtgaaatgcaagcccagttgctggatagtatggacttggaacgcgagcgtggtatcacaattaaactcaacgcaatcgaactcaactatacagctaaagatggagagacatacattttccacttgattgacacaccaggacacgtggattttacctatgaggtatcgcgttcgttggctgcctgtgaaggagcgattttagtggtggatgctgctcaagggattgaagcacagaccttggccaacgtttatctagccttggacaatgatttggaaatcttgccaatcattaacaagattgacctgccagcagcagacccagaacgtgttcgtcaggaaatcgaagatgtgattggtttggatgcttctgaagcagtgccaacatcagccaaggcaggtattggtatcgaggaaatcttggagcagattgtcgagaaggttccagcaccgactggtgatgtcgaagctccattgcaagccttgatttttgactcggtttacgatccgtatcgaggcgttatcctccaagttcgtatcgtcaatggtgtggtaaaacctggtgacaccattcagatgatgagcaatggtaagactttcgatgtgacggaagtggggattttcacacccaaagcaatcggtcgtgattatttggcgactggtgatgttggttacattgcagcctctatcaagaccgttgcagatacccgtgtcggtgatacggtaaccttggcagaaaatcctgccagcgagccactagcgggctacaagcagatgaatccaatggtctttgcaggtatctatccaatcgattccaacaagtacaatgacctccgtgaagccttggaaaaactccaactcaacgatgccagcttgcagtttgagccagaaacatcgcaggcactcggatttggtttccgttgtggattcttgggcctcttgcacatggatgttatccaagaacggattgagcgtgagtttaacattgacctcatcatgacagcaccgtcggtggtttaccatgtcaacatgacggacggtgaaatgattgatgtagccaacccatccgaattcccagacccaacaaagattgccactatcgaagagccttacgttaaggcacaaatcatggtaccacaggaatacgtcggtgcagtcatggaattggcccaacgcaaacgcggtgactttgtgactatggattacatcgatgataatcgtgtcaatgtcatctaccaaattccacttgcggagattgtttttgacttctttgataagcttaagtcgtccactcgtggttatgccagcttcgactatgagatttctgaataccgttcatccaagttggtgaaaatggatattctcctcaatggtgacaaggtcgatgccctcagctttatcgtccacaaggaatttgcctacgaacgtgggaaaattatcgtggacaaactcaagaaaatcattccccgtcaacagtttgaagtaccaatacaagcagctatcggtcagaaaattgttgcccgtagcgacatcaaggctcttcggaagaacgttttggccaagtgttatggtggtgacgtttcccgtaaacgcaaactcctagaaaagcaaaaagctggtaaaaaacggatgaaagccatcggctctgtcgaagttccacaagaagccttcctcagtgttctcagcatggatgaagacgataagaaataaacttgatacaaagaaacactcctgcattttcttgcaagagtgttttctcttatttacgtttcatttcaccttgtgggtagtaggtcccttcaggcatatcattgatgaagacatgaatggcttctttgggcgcattagtattgcgtgataccacctcagttacttcacgcgcaagggcaattttttgttcttctgtgcgtccttcaaacaaatcaatacgtacaaatggcatatatttcctcctttatttttcgtttattgtaccatagtttttatgattctccaaggatattttcataagatataacaaaatatatttatattttgttataataatatcgcgacaaacaataaggagaatgatttatgtttaagaaaaaagcaactcagatagttagcgaaacgtcaattaaaaaatctagaaaatttcttaatcggaaaacagcaggaataactggtggcgtcctacttacaacatttatcggttcacaattaatgactgctgaacttccaaaaaaagatgacctttatggacaacagtatgtaacagtcgtaaaacatcttcaggaagcaggtttaaaaaatattcagggggtggaaatcactgatttagaatttggaaaaataggtgaaagcaatcttgtcgaactcgtctctgttgacggagaagattggaaggaaggacgtactttaaaaaacatcccaattacaatctcctaccatgttcccaaaaaagatgccgttgaattcaacctaccagcttctaaaaatttagcagatgtcgagaaagagctgaaagattcaggttttatgcaaatcgaactaactcctgttctgctagtagaagaaggcaatgcggacaaaaaagataaaattgatcgccttcaaatcggaaatcacacctatcaatccaatcatttttactctactagtctccctgttacattaacctattttgacgttagcaaagataacatcaaactaccagaaaatctagcagaggctaaaacaaaaccagagctcgaaaaacaactaaaaacagcaggatttacagacatcaagtggactgctgttgcagacaaggataaagcaaagcacgaaaaaattcaaaaaattaatctaggtggtgcagagattcaattgcccaccaaacaggagattatcagcaaaaaatcaacccccattgtaattacctactacgatttctctagcttcgctgaactgccatcatccatttcaacgaaaacagctgcagatactaaaaaattgtttaccgacggtggtttttctcaagtatctgaagtagcaacagagaccaatgaaattgctaaaaacggacaaatcattgcggtcgagattgatggaaaatcttttaacgagatgaacgataaggtcatcaaaaaagatagcaaagtcattgtcaaatattggaatgctgaaaaagctattgctgagaaagcacgtaaagaggaggaagaacgtctcgccgccgaagcgcaaaaagtagcagaagcacaaagccaagttcagcaatttactgctacaccatctcaaaacacatattatccaaattgtaaggcagttagacaagcaggagctgcaccaatctatcatggagaaccaggttacggtagtcatttagaccgtgatggagatggagttgggtgtgagtaagaaaaaacattgacaacgtttacattgcgtgctatactactcttataaggagggattgctcatgacctataaataccgtatgattttatcgttcctactcactggattatttttgtatctagtagtaactgtttttaacaaaagtgtatgggaaggcccattgtttcttgcattttctttttacagcctgatatatggttgtgttatgctctacaagtggaaaccaacggcagctaaaatcattttccgatgtattggagaatttctctctttaccatggtcttaatatcaaacaagctcaaaacgggcttgtttttctatttcctaaatggtcaatttatgatagaatggagggagtgaaaatttaagattggaaagagaaaagtggctcaattatattataaatatgggacaatgaactcaggaaaaaccattgagattttgaaggttgcccacaactatgaagaacaaggaaaacctgttgttatcatgacatctgcacttgatactcgtgatgcctttggtgttgtatccagtcgtataggcatgagaagagatgcagtggcgattgacgatgatatggatatctttggttttattgaaaaaatggaaccgcgtccttactgtgttctcattgatgaagcacaatttcttcgacgtcatcacgtctacgcacttgctcgcgtagtcgatgaattagatgtacccgttatggctttcggtcttaaaaatgatttccgaaatgaactatttgaaggttcccaacatttgctcttattggctgataaattagatgaaatcaaaacaatctgccaatattgttctaaaaaagcgacaatggttttgagaacacaggatggaaaacctacttatgaaggagaacaaatccaaattggtggcaatgaaacctacattcctgtctgtcgcaaacattatttttcaccagaaattaaagatttaccctaatttttgaaaatgaaatgagaagcaactgtaaactgagcaactatatagaactgaatttgcctatgactctgtgccaattttcataacttacatactacggcaaaggaattgaacacgccctacaagctgtgtcaaaaagataatttctccaagtgtttgtaacacttggtcaaaattcctattttgactgtgcttgcttaacgggctttgtatcttaatggaattgaacacgccctacaagctaactagaagtgtgtgcggtcaaatatttagaaaggaattgaatacgggctacgaactgtgcctgtttcatgacctacatattacagaaaggaattgaacacgccctacaagctgtgtcaaaaagataatttctccgagtgtttgtaacacttggtcgaaattcctattttgactgtgcttgcttaacgggctttgtatcttaatcttatgaacatctacgatcaattacaggcggtggaagaccgctacgaggaacttggtgaattgttgtctgaccctgatgtagtcagcgataccaagcgttttatggagttgtctaaggaagaagctacaactcgtgatacagtaacagcctaccgcgaatataagactgtacttcaaaacattgtcgatgcagaagagatgattaaagaatcttctggtgatgctgacttggaggaaatggctaaggaagaactcaaacaagctaaggctgataaagaagcttacgaagaaaagctgaaaatccttcttttaccaaaagaccctaacgatgacaaaaacatcatcttggaaatccgtggtgccgcaggtggtgatgaagctgccctctttgctggagaccttttgaccatgtatcaaaaatatgcagaaggtcaaggctggcgttttgaggttatggaggcttcatataacggtgtcggcggtatcaaggaagtggttgccatggtctctggtcaatccgtttattcaaaactcaagtatgaatcaggagctcaccgtgtccaacgtgtccctgtgacagaaagccaaggtcgtgtccacacctcgacagcaactgtcctcatcatgccagaagttgaagaagtggaatacgacatcgatccaaaagatcttcgtgtcgatatttaccacgcatctggtgctggtggacagaacgtcaataaggttgcgactgccgttcgtatcgttcacttgccaaccaacatcaaggtcgaaatgcaggaagaacggactcagcagaaaaaccgtgaaaaggccatgaagattatccgtgcccgtgttgcggatcactttgcacagattgcccaagatgagcaggatgctgagcgtaaatcaactatcggtacaggtgaccgctcagagcgcatccgtacatacaacttcccacaaaaccgtgtgacagaccaccgtatcggcttaaccttgcaaaagctggatactatcttgtcaggtaagatggacgaagtcgtagatgcccttgttctctacgatcaaacgcaaaaactagaagagcttaacaaataatgaattacgctcaattatttgcagcatacgaagaacaattagtcgcaatcggtgaagaggcagaatccctgtccttcacctttcgtggcttaaagggattgaactttacggaatttctcctcctgctccgtcaggaagtcacaccgactgacaaagaagagattgatgcgatttttcagcaactttcccaacaccgacctgcccagtacattatcggcaaagctgattttcatggcttggagtttgcggtggatgagcgagtcttgattccaagacctgaaacggaagaattagttgatttgattttgcaggaaaatagcggagcaagtttgcgtatcttagacatcggtacaggaagcggtgccatagctatttcccttgcaaaagctagacctgattgggaagtggtagcggttgacatttcaaatgatgccctagcagtggctcaggaaaatgcaagaaccaaccaagtctctgttcactttctagaatcggatgtcttgcaagctgtgacagggaaatttgacatcattgtttctaatccgccctatatctcaccagatgacacagatgaagttggactcaatgtattgacttctgagcctcatcttgccttatttgcggaagaagatggcatggctatctatagacaaattgcggagcaagcaggggcatttttgaaggaaaatggaaaactctactttgaaattggctacaagcaagggcaagacctaaccgacttactcgctctgcatttcccccaaaagcaaattcgagtcctcaaagaccaatttggacaggatagaaaggtcgtagcggatgacaatggataaactccgaacaattcttgaaaatggtggtgctgttatccttccaactgaaacagtctatgggctttttgcccaagccttgaatgaagatgcagtcaatcgtgtctatcagttgaaacagcgtccgcgggacaaggcaatgaacttaaatgtctcaaatctgaacgatatttattttttcagtcaaaatacacccttttttctggagaaactgtataatagatttatgccaggaccgctaacgattatcctgaaagcaaacgacaacgttcctttttgggttaattctggactggatactgttggttttcgtcttcctaatcacgaacaaaccttacgtttgatttcagagactggcccacttattggaccgtccgccaatatttcaggaaacgaaagtggcaagaagttttcggacatccaggcacaattttcagttgatttgcctggcattgaggatgaccaagctctaacaggcattgattcaacgattttggacctttctggacagaaagcgcggattttgcgccaaggtgctatcagccgcgaagagattcagaaagccattcccgaaatagaatttgaggtagttttatgattcgtcccattgagaaaagtgacttgatagtcatccgagaaatcaatgctcaatccttagggtatgattgttcattggaacaaactgagcgacagttttttagatgcacgagcacattggggcatatcttgttggtctatatagatgacataagtggcgcagtgcaaggttacattcacgcacaagtctatgaaagtctctattcggatacaggcctcaatattctcggactagctgttttgcctggtcatcaaggacaagggattggagcaagcctgctgaaagccgttgagcaaattgcacagaaagagggctaccattttattcgcctcaattctgctgaaagtcgtctccaagcccatcttttctacgaaaagaatggctatcactccgataaaatgcagaagcgttttatcaagcacatttagcccaatacaaaggagtaccgtatatgatttttgacaaagttaactacaaagaatttgataaagaagtttgggaagctatccaagctgaagaaaaacgccaacaaaataatatcgaattgattgcgtctgaaaacgttgtttctaaagctgttatggcagctcaaggttctattttgaccaataaatacgcagaaggttacccaggtcgtcgttactatggcggtacggaatgcgttgacgtagttgaaagtttagctattgaacgtgctaaagaaatattcggtgcaaaatttgctaacgttcagccgcactcaggaagccaggccaattgtgctgcctacatggccttgattgagccaggagacactgttatggggatggacttagctgcaggtggtcacttgactcacggtgcatcagttagcttctcaggacaaacttacaactttgtagcttacaatgttgacgaagaaactggcttgcttgattacgatgcaattttaaaacaagcaaaagaagtacagccaaaattgattgtagcaggtgcttcagcctatgcccgtacaattgactttgctaaattccgcgaaattgcagatgcagtgggggccaaactgatggtggatatggctcatattgctggtcttgtagcagcaggtcttcatccgaacccagtgccacatgcccatattacaacaactacgactcataaaactcttcgtgggccacgtggtggtttaattttgaccaatgatgaagagctcatcaagaaaatcaactcagccatcttcccaggcatccaaggtggtccattagagcatgtcattgctgcaaaagccgtatctttcaaagaagttttggacccagctttcaaagactatgctcagaaagtgattgagaacagcaaggccatggccgaagtcttccttgcaaaccctaactttaaagtcatcacaggaggaacagacaaccatctcttcctcgttgacgtgaccaaagttgttgaaaatggtaaagttgctcagcatctcttggatgaagtaaatattactctcaataaaaactcaattccttacgaaaaactctcaccattcaaaacaagcggtatccgtattggctctgcggccattactgctcgtggttttggagtagaggaagctcgcaaggttgcacaactaactatcaaagcacttgaaaatgcagaaaatgaaaaagctcttgaggaagtccgtcaagaagtgcgtgctttgacagatcaattcccactttacgaaggtttataatggatatatttgtaaaaaaagccatcatacatcaatttagtcctgatgatacagagctggtcctttccgaccagcttttgactgttagcccaaaaatagaagaatatttgcgtaaaaagattgaacgtgtcttttctgatgaagcaaaaacaggacaatttaaccccgacaatccttttcttgactatttagatggcgacctactgaccaactctgtcaagattgctaatctatggaaagaagaattttcaatttctgagaatttaaaaaccaatgacctcattttcatagagtttgaacgaaatggtgttgaacattttgcctttttgagaatctcactgcgtgaaaatctcgcccacgttggtctggaaagcggaagtcctttaaaaatcacccagaataatttacctggagcaggttcagcacctgatgaagccttgattgtcaatcttcaaacgcggaagtatcatttgattgagaaaagaatcaaacacaatggagccttcctcaattatttctcagataatcttctgcaagttacaccagctatttctgcaaaaaaatcaatcaaagcagtagagcaaactgcacagaagattgctgacaatttccatcaaggcgattttcaatttcaatcgaaagtcaagtcagctattttcaacaatttggaagaagataatgagctttcacctgaaaaattggctgatcagttattcgataacaacctgaccgctcgtttaaatttcgtcgatcaactgaaagaggtcatacctgataagatttccttcgatgaaattgatagtagccgtcaacttaagaaatttgaaaatcagaagctatctttatcaaacggaattgagttgattgtgccaaatgcaatctatgaggatgcagaatcggttgagtttattcaaaatgacaacgggacctattctattcttatcaaaaatattgaagacataaagagcaagtaaatgaaaaaactgatacgtacgctgatacttcttttgctgatttttctcggttacaaattctatcaaacctacaatgcagtcaagcaagtgatgacctatcaaactatggtacaagaagtattggctgaaaacgacacaccagctaatgaagaactagtcctagcaatgatttacacagaaaccaagggacaagaagcagatgtcatgcaatcgagtgagtccgctactggctatgctaacactatcacggatagtagagagagtatcaggcaaggaattatctacctgacagaaaacctacggttggctgaggaaaaaggagtagaggtttggacagcagttcaggcatataatttcggtccagcctatattgactatattgctgaacatggtggagaacatacactctctttagctaaagaatactccagaacagtagtagcaccaagcttagggaatactacagaagaaacatatacctattttcatcccttggctttgctaaatggtgggaagttatatgtaaatggtggaaatatctactatgctagacaggttcgttttaatatgcacctgatgcgcctcattaatttattttaatacctatcaaactcatcggaaatctgatgagtttttaactacagcatttttacaaactaggtaaaattgtagtataataaagagaataggagacagagtgatgaaacgaaatgtattgattacaggtgcaagtagtggtattggcaaagcaatcgcttatgtgtttgctgctaatggtgataatatcatcattacaggacgaagattggacaaactagaagaaattaagcaagatattgaaaagcaataccatgttcaggtgtcagttcattcatttgatgttacgaatatggaacaaacgattgtaaattgtcaaaaaattttagaagaagttggtcaaattcatattttggtaaacaatgctggcctggcattgggattggacaaattccaagactatgatttgactgacatgatgacaatgattgataccaatattaaaggattactaactgtgacacgtcagttattgccacaaatggttgaaaataatgagggtcatattatcaatattggatcaacggccggtatttacgcctatgcaggagctgctgtctatgctgcaaccaaatcagctgtcaaagtgctttcagacgggatccgtattgacacgattgataaaaatatcaaggtaactacgttacaacccggtatcgttgagactgattttagccaagtccgttttcatggagataaagagagagcagcgacagtctatcaaggaattgatgctcttcaagcaaatgatattgccagctgtactctatttgttgcaaatcaacctgcacatgtgcagatttctgatatgaccattatggcaaccaaacaggcaactggctttactattcatagagattagaggggagatagctagaatgaaaagaaaatatttagcactcgctcttggcttgctcactatcatgtcgctttctgcctgtcaaactgaaaagaagggcagttccgcaagtacctcaactgctgatacccaggtttctaatgccaatacaagcaggtcatcaacaatccaacgtgagatttctcttagttctatggatatagatgctctaatgcaaggcaattacgatagtatactaggcacctggcaaaatagccaaggaaattcactagtcttcaatagcaaaggattagtagcagatagccagtccttacttggccgcggaaaaataactgacggaatttttgaaacaggctatgtagacgcaacgattggcgatgtaacactattaatgattcccaaaggaacacaagcaaatacaactgagacagacactactgactctacgcgcgatagaatgattgtaataagccaagaaacaacagcagacgtggtagatgtctattatcgcttgaccaattcagccactagcggtatagacccattaaaaaatactgaaacaggcgtccagttggatagtggaccaaaaacgattgattatgccaactcaattttaggcgaaaacaattggcgcgtcattgaaggtaactacacgcgcaccgaatctattccttataatattttggaaggcgatgataatgcccgttacactatttaccaaaacggtgttattatcaatgcagattatcaaattgtttatcaaccataatgattctctaggaggttagatgtgacattcacatcatttgaaccaacacgcaatgtgcaagattttcatttggcagcatttgcctactatgatggactagatgtaatcgaccaactcaagccaggaacacctgttcagctagtcggagaaccttcaaacccacatgactcagaagctgtagcaatcttttatcagggcacaaagttaggatatatcccatcggataaaaactcactaatcagtcgcttaatctattttggacacggcgatattctagaggcacgtattcagatgtccaatacagaaaatcatcctgatcgccagtttcgagtcgttgtaaaactaaaagataatcgtaaaaatgatagtcggtaatttaccaacctacccattttctacttaacacggagctgtgctctctgtttttgttcttcaataatgcttaaaaaggctgcaaactccctatctaggcgatgttggtaggccttattttttattgtgagatcttccaggaacactggataggttccttttttatacaattctccttgaaagaagaagcggtccgataatttatcaactgaaacaagagaagaacgccagcggcttttacgagaatgagaaggtttccaagatatttttaattgcttctcataaaagtaccagcccataatatagattttagtaatctgatttcgttttctgtcttgatagaaacaaggaactgcataaacatttccatgctttgtttgcaaaaaaggatggaaatcttttatcttttcgtattctttctttggaataagggttaattgattatccttaataaccttcttttcatcaatagtatatgaataacggtaggggtcataaatggttgattgtccacgcgctctataacgctctgccatttccttaaaaataggtagacgtctataaccatccatcagactagatagactaagccctcgtcgattattatttttcttcacaccaagaatctggcaggtagaccaataattgataggaatggctcctaatcctaccagaagaccggcgctgtcaaaatgactggcaaagcgtacctcacgagtgtgaccagtctcatttttcaaatcaacaaatacaggttgcttgtcctgttcaaaaacaattatataatttccagaagactccgtattttctctaattggaacggtgtagaagtggtgaaaatttggtaattctagtaactttccaagtgttgatgttttcataacacaagtataacaaaaaatatttttcaaatccacaaaaatgtttaattcgttaaacatagatataaagaagctgggaaagacatccatgacgactttcccactcccaccgtttattcaaggataggtgatgattgtcttatctaccgaatcttctaaagcctggcgcgattcttctgataaacgcaaatccgcaagggtttgttctgaaaaatagtagggatttagactatctacaaatgcagaaattgaaatgacagctttctccaatatcagagatttttcagtgtaagcaaagggaatagcagaccaatcatcactctcgaacatttctaaaatatctttttgaacttgaatttcagcctcatttttagctgaaactaggattgtttttagtgtagcacgaaaactttccttgtcttgcaccaagtcttccaaggtcaacaagctttcatctgccttctcatagaaaatatctaattccgtctctgacgaagtagtcacatggagccagtcagccttgatactggttttcattactgcataggcagaagcattttcaaagggactgctgcgcgtttgaggatagagaacaatccactctttctggaatagattgtcaggtttagctattttcagttcctcctcagaagctgtaccaatccgctggctgatagcagtagtgtcatcttgctgaaagaatccaatgatacgcggattttgcggaccgccaatggcatcaatttttgttcccagatcattaataatgcgtatgttcaaggcatgacactgctcatttaatagtctattttgctcttttccgagccagtagattccaatacaagatagaccagtagcaataagcaagacaagtaacagcactttcgagtatttcagcacagccatcacacctttctaaaacgctttcagtcatatattatcatatataaatatcaaaagaaactattttaaggtaccacattaaactgttacacaagtatataaattctaagtttacgacaggaatgtttaatgataaaatataggtaaattcgaactcataatttaataggtgtagatacaacaccgttggaggatactatggatgaacaaaatcaattcaattgggtaaacttttataaggaatttgcttggaaattagtagactataaagataatagagcagagctggttgagaaagtaaaagctatctataccaaaacaaagatacatatgcccacgttagaaaaggacaatcgactgatagatattgatccttttacgatatttggactcttcaataagcaaataaaagaggagaatcgcattaaaattctgacagctatagcagaattattcaacctccaaacggaaatcccatcctcttttgaaagtataccagtactgatgaatcagaatgcgactttctattattttatcggagatcgtgatgagaatgatattgatgacttatgggaacttttcattgctgctttgacctatagcaaggagcctacggctgagaagaaagaaaaattttcacactattttgatttggctataaacaagaaaggaaatggcaacagcaagattacgatggccttgtattggattgctcccgactttttcttgagcttagatagtcaaaatgaagcgtatgtgtatgagtctggggagattccaactgacattgtccaaaaattaccaaagatgaagtcaaaaatttctgccgatgattatttttatatctcggactctatgcatcattatttaaacagtgcagagagcaaactgaaagattttaaagaattatcatccatggcttggaaatactctaaacagatcaatcaagaagagaaggaaagaagtgctggaacaatttctccactggctgatgaaactgatactggaaacgagataggtagtgaagaggtagtagaagatagctatacgaaaaatcacttcctatcagaagtctatatgacagaagaagagtatgatcaattaacctccatactccaaatgaaaaagaatatcatcttacaaggagcgccaggagttggaaagacgtttattgcagaacgcctagcattttcattaatgggtaaaccagatttagaaagggtcatgacaattcagtttcaccaaagctattcctacgaggacttcatcatgggctttaggccttcgacaagtggctttgagctgagaagaggggcattctatactttctgcaaaaaagcagagtctgacaagagtcataattatttctttattattgatgaaataaacaggggaaatttgagcaaaatttttggtgaattgtttatgctgatagaaaatgacaaacgaggcaagtctttacagctcctctactcggatgagcaattctcaattccagaaaatctatatatcatcggtatgatgaataccgcagataggagtttggccctacttgattatgcactgagacgacgctttgccttctttgacatcaagccaggtttttcaactacgggattcaaagattatcaagcaaatctgaaaaacgaaaaattcgatagactcatttcctgtgtagaaaagctaaatcaggccatttcaacagaggaagtactgggagatagcttctgtattgggcatagttacttctgcggtttatcggcagaagtactggaacaaggtttgctagaagccattgttgaatatgaactgattcccctcttgaaagaatattggtttgatgaaccgacaaaaatttatgattggagtagtaagttaaggagtgccatccagtgatacctgtccaaaatatctactatatgctatcctacgcattcaaaatccttcatgagcaggaatataaacggatcgctactgaagaatttaaaaatgctgcagatctactggcggaaataatgataatcagcctctcgatacaggtgaaaagaggacttggtcgagagtatcgttctcaaaccgagtcactctcggcacttaaaggtaaaataaatatctctgaatctttaacacctccgaattggcgtagaaagcaacttgtttgccaatacgatgatttttctcttgacagtagaatgaatcgcattatcaaagcaagcattgagatactgctaaaagctgatataagcagggacaggaaaaagaaattgagaaaactcttagttttctttggagaagtctcaaaaattaatctacactcaatcaattggaatttacaatacaatcgaaacaatcaatcgtatcaattactaatgtcaatctgctatttggtggtgaatggattaattcatacagagagggaggggaataagaaattgatgaattttcttgatgagcggagggaatccttgctatatgagaagttcattcttggatattataaaaagcattatccccaaatacaggttaccgcctctcagataccttgggcactagatgatggttttggagaaatgctccccatcatgcagagtgatatttacctcaaatataaagatactatattgattattgatgctaaatattattctagtaacacacagattcgctttgataagcgcacactccattcaaataatctataccaaatttttacctatgtgaaaaaccaggcttatcgcctgtcagattcaaacgatacagtagcaggaatgcttctatacgctaaaaccgatatagatattcaacctaatcaggtctaccaaatgcatggaaaccggattagtgtcaaaaatttggacttaaacctgccgtttgcaagtattgctgaacaactggatgacatcattacatcgcattttgcatcccctccaaaactgtactagttagagctctaagctagaaaacaaaaaaacaatcaaagtagtagcactaaactactctttgattgtttttttataagactctttcctattttggagcgtctggttaattgatttcccagatcagcgacacttttttgtttttaggcatcgggtaaattagtccactggactaatttactcccactcaattgaaacaggtatcctcctatcccttgtaggacaagggactagaagtagtatatacatcaaaggggggagttttaggggggattgattttttcatatgttgatttccattaaattttactttagtttcgtgtgcagtttgtatgtttattgcattagtgagtagctgggctatctccttatcagcaccactgtacaagtgagcatagtgacgcaaagttatctcaggacttgaatgtcctaatctctttgaaagcgcaagaatagaagcttttaactcatttaaaacatagcttgcatgactatgtcttagacctttaggttgaatcctacgaacacctgcaagctctgcatatctatttaatattcggtttatggttgattttatcatagggtagccatcgtaagtaaatataaagtcattttctttaccaagtcctatttgagtttgtatttctcgccattgccttaatatactgacagttgtatcatccaattcaatgattctttttccatcatctgtttttgtatattcttttctaatgaagttttttcttgattgaacctcaagcatgtggtgtatgcgtaattgttgttgtccaaatgcaatatcactccaatacaaagcagttccttcattaactcgaataccagtcgtataatatagatatagcattacaaaacataaatgttcgtatacatcatctaggcatatttgttgcaagactaactcgaattccgtccttgtccaatatgggacaatttgctttcctttcggaattgcctttactttttttgaaatattgtattcaagaaaatttctctcgacagctttatcaagtgttttacgaaacataccaaaaactagggaagcatatgattgactgtaacctgagcctccattgttttcatctgtcagtagccaaatcttaaaattatcaacatcagtcacgctaatttcacgtagttttaaatcaccaaatttttcaataataagttgtaaagctggatatctagtattaaacgttgaggtctcgacgtatgaacgatagtaaggaatatatactgtgtccataaattctcgatacttcatatggtaaaatgaatagccatctgctttatggtattctctttttattctagtaacttctttatgtgcttgaagtgctgatgtaaagatattcccgaatctatcttttgattttttcctccttatcctctcacctgttgctttgtcagtacctaattcaatctgataaaagaatttacctgattttaggtctttgtaaacacctggatacttagttttttgttgggttttgtttgccattctcttctgtctcctctgaaattgttactccaattaatgattcgacagcagaagctggaacaatagcaagtctcttgttattatacaaatagtaaccttgattgacaagattcagtttaacttgtttgataatgcctgtggcttgatattttgtaaaacccatctttatcaaatgggatttttcaatcattttgtctgtcatcattttcctcctgtgaaattttgagagtcatttctttgtacttgttataaacatctgaattaaattcaattttatctttatcgcaatcgtagtaaggattgtctattcgctcatattctatatatttatttttttcgttatcaaatttgtatgtaataatagatttatcagttacttcttgaagtagtgtaatccgtctaatgagctgaatcacagtatcaattttcttatcaaagccaacttgtttgctaattgattcgtaaaattgaaaaggcgaaaatggagtgtttattattattgttgttgcaataattggtttatcaaagaaacgactggaagcagtagcatcagcgttgaatgggtcaatgataagtaagaagtcagcgtaattaaaattacctccccgacctggtctgatttcctcgataattatagtttcttgtgaagcgacattttgaaatgggtcacgagaggaacctgtagtatagaatggttttccaagtgattttgcaaagtgtttgcataatctcgattttccagttccagatggaccataaagccaaattatttcccgcttaaacccattttttagtgcattttctttccaattttcaaaatcaatttctgttcgtcttttcttagctcttgaaaattctctatcgtatttcacaagtgtatatccatcaacctctttaattgcttcgtcgaaacttatatctccagcgattattttatttatgagatttcggacaacgttgattgttttttctttcctagagttagattggatttttgactcaatgttttcgattctttcagcatagtcaaagtttgcgataacttcatcaactgtatattgatgtttttcactagcatcctccgtacgatgaattaaataagaataagcgttatttactttacctttccatgcttcgaaaaagtttgattgaacctcaaacccattttgtgaaagcttgttgataattgaatttaaccaaacagcatttttaaacctgacgataatatgatagtgtggttctgtatcaatatctttatcatgaatgatacctgcaatttcaaatggattcaatgtttcttgaaataatttgattatttcttgcaaatttttaattgaaacactttctactgttgaacagaacatataagcagtatgtcgaatagaaggtaccttttctgacatttttctctttttcttcattttattcctttcaaatcttgacaatgacaatgtaattcatgctgtctataacaagcccagacagcatttttttctagagcagatgttactcttgacaatgacaaaataaaaatttggatgatttaatcgctatgtttcgtcagtgcaaatcttcaataaatgttcttacgaaatgcacaattgaaatagaattttagaggaaatatgataaatttttcattattttttctcaataatgcatgctaattcttgtataaactagaacgatggaaaaattgattacttgttaagcgttactgctcaatagctagtcattgcccttgttgaggctgattttctaaagaactgtgatttcattcatctgtctcgcaggcctcaacagcttacattcaatcacagttcttaaaagaaattatcagcaaaacaacaaatcgggcaacgatagattgagtatttcacttaagtacaagcaatcaatttttatcggtttctagagttattttaaagaactagtcatatattaactgagaaagccaatacaaaaatcgaaaaatcgggttatcatctttccaatcttcaaactctctttctgctttgcgcttatctcgttcaagaacacgtatttcttgattcacacttgcacgttctctaatagcgtttgaaatatctttctcaactttttctttgtcactgagcaatcgatttaactctacatttctagaagttaatactgactctgttctttttaaatcagcttttgtattttcaagttgctcattgtacagcttttcttgtagtcgtaaaacagaagaagtatcacaatattcaccagtatatttatttttaagtactaaaaaaactggtgctttttcacgctcttcatgaccgattatcatgtcttctagactacttgaacattttaacttgaagtctttttttgacatttcactataagtgatgagggcaatgtcaaagttagttgcttcattttgtagtgtatgctcagcgacagtcgatgacaaagttatcttcatttttcagtttacctttctttttaacgcttaaaataattgaattgattcagctctgaaataaagcgcaccattgtagtcataagcttctaaattatgaaatttatatccaataaatattttcaaattcttgtttaattcagctggaagtgcaacttgaaacggctctgaattatcttgcataaaccaatatttgtatcccgctatcttatccgttctaccattatcatcgtacttaaatttcaaagtatagtcggtagataacaaatagtatggtttactaacatcagttacaacgctcgccaaaactgaaggacttagtttttttgttttcattcttaattttcctctcatgttcctagtcttttttgtagtatacttatgtgttaaaatattctacaaagagttaaaaaatcaattaacgttaatctatattcattatatcttctataaacttgtgtgtaaaaaacagaaaatagttcgaatccgaattcgtaaaattataaaatattcaagttatataaataggctcacatgctaattagtagatttcagagttttaagataaaatccgggaggagcaatgttatgaaaatatatttcaatgaaaaagagcttgaaatagcttctgtagcaacatttttggagggaacatatgacttcgtagaatacaaaaataatattttttatgaacatattaaagagtctgataagttaaatggccagagtaggactgaccactgtatattatttagaatttttcaagaagaagttgaagaattgatttctaattcaatgttagtagaattaagcaacaaactagcaaaagtatttactaaggagccacttgtaataaactatactcactggattgtggaagagattacaggcaaggtacgactaaataataagaataaggagcagatacataagttaattgctgattttatcctttacatctctgaaaattattatgataaaaaaatggagactcaactacttgctactgaatcgttagttacacttatacaatttgttgatggagatatatttcttaataaacaagaaattgagtttctaataaataatcaataccttacaaaatctttacagattaacattgagaagaatgatgattataagctcgaatctttaatgcgtctagtcagaaaatgctcaactgacaaccacaagaattttaatggtcactacgaactaaaggcaacacttgaagcaattaaacgcagtcgattaagcaaatcgccacagaaaatttctactcttatccctgaagattatagaaagttagaaaagaaatgggaaagtacaaagatacagttgcaaaattatattgaagaatatcgaggtttagaccaaaatataaactgtactttaaataaattgaatgatgatttcgaagactattatttggaactaagaaaatgtattcagaaagttacaattactatgcttatcattgaaaatttgaacagtagcagttctgagttggaaataatggctatcgaaaatgtcctagattccttgaatattaagaaatactcttttaaaaatattttgcaaaaatggaaagattttgagaccgaactcaaaatgcaggaccttgagtcgatgtattacaaagatatgtatgatttaatagatgaatatttaggaaaagtaattgattatagcaaatactcgaatgattttgaaaagtccattattcaattattacttaaggttgaagaagcactcgcaattacagataatagtgataaattgtatatagatattaaaaagaaacttcagcagtccaaggaggattgccttgaatatgccaaaattattgatatgagattaaaaaatttcttagaaaaccgaatatactaaaagccaagcaattgtgcttggcttttagtattcatctagttcatgtttgattatgtcttcaacattacattcaaggatttcacataatttatcaattgtttttgttgttattggttcacctaatttcattcgatgtaacgtatgtgcggaaattttttcaaccttgattaaataatattctgaaattcctcttttattcaaagtatcatagaagggtttatatgaaatcatgttattactcgctcttaaattctcttatataaacaatatggtaacattaccaacatattgactatattcaatttattgagtataattttagataataaacgtattagaggtaaaaaatggatgttttattctctctaaagagattttcaaccttaaaaaataatctaatcccctcaacacaaaatagaataaaagaacttggaagagaaatttttcaagctgaggctactctgaatgctatttcagatgaaaaagtatttcttgaggactttaaatgggatattcgcacaagaggatttactatttttaatctgattcacctaccgtccctgattgtgtttgtcatatttattatggttacacttttatctttagcagggattaccattattggtgtcattatagaaacaattattcgaacttttatacttttccaagattttgagtttgaggatacattcttctatatcccaataaaagcggttgaagactttatttattatccaccttcaattcctattccgattgtggttgggcttttgatagtctgggttctatatagtatcagacaggttcaaaaaaataaaatctactatgaaaatgttgttattccagagaatcgaaagaaaaatgctctcgtccctggaaagcgtagaaaacaacaattagtggtagataacctgaaaaataccttgaaatccactgaaactcaactactgaaccatcaaaatgaattgatgaatattatgaatactatttccattcccaaccagtattggactaacgatgaagtcataaatttcctcatacagaaattagagtatgggcaagcgaagaccatcggaaaagctttgaatctttgggatatagaagtatcaactagaagggttgagcaggcatcgaaagctgtcataaaagagacaagagaatcggaagctcgtctagctagacaacgtgcagaacaacacgcgcaagagcaacgtaacattagagataataccgaagctcaaaataaagtagcagaagaattaaaacgaaggaatgaccgttctgagttctatgatgatattgcgaagaaaaacggttggttataaataaggagactcactatgaacaaaaagaaaattttagcaagcttgacactattggcatctacagcactcttatttgcttgtcaaagtaatgaaagcaccacaaaatcctctgaaaagattgttgaaacctcatcttcttcaaaggatgcaatctccgaggaacaaagaaataagtggttgaaggagttttatgaagaagtagctgagactgatggttcaaactatcataatgatattgaagaacgtagtcaaaaagcatggaatgagaatcaaaccaacattttcaatggacaggctagtctaaatgttactaatggctacctaccttctgaattgacaaagctaaatgtcacgattgacggttatgatgaagcaactagaagattgaaagttactgttactaacaactatgatacaacactgattggaacaacaaccaattcaaacaataacaacttgtacaggacatatttcactctatatggctacacaacattgtcaggacgttctgagagggttaaaatcgctcagattgctcttgctagtgatttaccagctggggagtctattcaacttgaaatcctttcatcagctcttgcaaattcacaatctgattatgctaaaaaatttcaaaatagtgagttagattctaaatactacttactatcaaccaattacggaaattccttatgggacattactaaagaccaagtaatgggagaagagattatttcagaacaaatagtattatctagccttgcgaatatctacattgtacccaagctagtatttgaaacttacccatctacagctccaaatgattctgagctagaaaatctaatttcaaacaattaaagaaaagagcagactgatgaacataaagaaactaatattgaccctactcactctaacgctgacaattgtcccttgtgcttgtggtaatcaatcgaattccaatgatagtcagttatcaggaacatattcatacgaaaaaggcggtattgatggttctgaaatgggattcgaagacgaagaattaactttgcattacgaactaaaagtaagtggtgatgaaaatatacttaatatcaatctcctttcagagagaggcaataatgtgaagtacctctattctgagaaagtaacaattgatacagacaaacagattatcagtgatagcaatggtactgaactggaatattcagtatctggagattctgttacaatacctgatttagcaggagatagtggtgaaacagtaacattaaaaagataatctcacaataataaaaaaggtcttgataggtctcaagaccttttttatgaacacttattcaatttaggtaacttcttgtaaagattggatttaaaatacctctaataccgaaataatgatataatatttattatcaaattagtgagtaaaagttatgtatatttttgaaacaactgaacagaataattccaaagcaaatgattttgaaacaaaatcgttactttatttaatgagttttaaatctgacagtacagatatagatacattttttgtagattgttttaatgatattactggagctagtagtgacttgttgaaactctgggatgttcaagctaagaacatttcttctctaagacctaaaactatcgggaaaagtctaataacattatttcaaaactttatatcatctgttgatttttatgagtatattctttttattccaaagttaaaagagaactatctaatggatatttcattaactgaatttaaaattgataattttaaagatatagctaaaatacaggagggtcttgaagaagaatataagcgaagaaagaagctaggtgcgctaaatctaaaacaattgtcacaattgaacacttttttagaacagatacattttgtaacaggtgatagttcaaaggccatctatatcaaaaatatcattcaatttaaaagtaatattagagatgacaatttctttgagtcagtttttaatgaagttagaagtaaacaaacagagttaaaaaacataaatatacataatatttcaatcaatagtattgaagaagttttaaaattaaacaaacatcttactaagagacaattggaaacattggttgttaataggataataggggttgaattatttaaacaacgtattccaaatgatttctttgatgtaatcaatgataaatcatcttcggataggaaagacattattcaagattgcaacgcaaatttatccagattattatttgataaaaatagtaataagaaaaaattttggtcacttcttgaacaaatattgattttagtagaagagaaagatgatatttatcaaattttaaatagaatcaaacaatatcaaattcctaaaattataaacgatgactatacattattatacctgatttcaatggttaaagaagggatggaagaaaatgcttgttaaaaaaattgctttcggaaatttagaagaagcgtttattgaagaaggattaactgacggtgttaatataatttttagtgatgataataacaaaggtaaaacgttattatttcaagcatttatgtattcaattggcaatacacctattttccctggaaactttaaaaaagaagattactatttttattcaatgattaattgcgcaggggttgattacgaatttttacgaaaaaaagacacatttctggttatttttcttcaagaatttcatattttcgaaactctttcggaattaaaatactttttaaaacaacaaaaaatttttgatattccagtgattgagaaaaacggtagggaaaaagtagcagatttagaacttttttatgagttgttttttgttggacaggataatagaaatccctcaaatattattaataaaggatactataataaaagtgatttttccagtatgatagtcgcattgaaaggatattctaatattagtaatagtaaagaattagatgaaataaaagaagaaatcaatgcagtcaagaatgaaattaaagccaataaaaaatatttaaaattacttaagacagataaacaagtttctagttatttggataaattcactagtaatgaagaatttgagaattttaaaaatcgttcgaagcaactaaatgataaaattggagaaataaaacgagaccgaaatagagaacaagctagacaggataaattagttcaactattgaaagagcttaattcgcttaatagggaaataaaaagcgggaatgtttattgtacagattgtggaagctctcatatcagctttaaaaatcgcgatgttaattttgacttaagtaatgctgaggttaggaagcatgttttaaattctattgattttcaaatttcaatgagcaaaaatgaagttactgagttaaatgaagaactcaataaaattcaagatgaattaaaaactcttttaatggatacccctaatgattttagaaaaagtttattgtattctgaaattatcaaaacagatatgaattatgatgataaattgttggaactagatagaaaactacacagcttacaatttgacaaatcaattatagaacaaaaaggattaacaaatagggatggaataaaatcaattaaagagaatgttgttgcaaaaatgaatactctttataaagtgattgacccagatggaaagttagtctttgatgatttatttactaagaaggaagctacatattcgggaagtgacggacaagtatattatttttgcagactaatctctctaaataatttattaaaacatacttatcctattatcaatgattcttttagagagggggaaatttcaactagaaaagaggagctaatgattgattattataagaaattaaataagcaagttattctttcggctaccttaaaaaatcaagagtatgctgtcgacaaatactcaaatatagaaggtgtaaataccattgactacagtataaatgatgacagcaagattcttaattcaaaatacactgatgagtttatacttattttaaaaaagtttaatatagaaacatcgacaaattattaaaaaactttttcagttttacgaattcctgtattaatttttaaaaaaggaaatagagtataaaaaaagaattagctagaaattttttctggctaattctttttttcggggggatttaggggggaatcaaacaaagattcaccctttttagactagtttgttcctgctaaactgctgtagaatctctattttgaaggtaaatcaagcctctccattattcccactcaactgttgctggtggtttacttgttatatcatagacgatgcggttgacgtggtcgacttcgtttacgatacggacagagattttttgaagaacatcccatggtagtttggcaaagtcagctgtcattccatcgacagaagtgatagcacggatagcgatagtgtagtcgtaggtacgaccatctcccatgacacctacggagcgaacgccagtattaaccgtgaaatattgccacacatcgcggtcaagacctgcttttgcaatttcctcacgcaagatagcgtcagattcgcgaacagtttgaagtttttcctcagtgatttcacccatgacacgaatggcaaggcctggtcctgggaatggttggcgccatacaacttcatccggcataccaagagcagtaccgagggcacgaacttcatccttaaagagagtattgagcggttcaatcaacttgaactgcatatcttctggcagaccaccaacgttgtggtgagatttgattgtctcagcagtatccgttcctgactcgataatatcggtataaagtgttccttgcgctaggaattcaacatcagtcaacttgctcgcttcatcgtcaaatacgtaaacaaattcattaccgatgattttacgtttcttctcagggtcagatacgccagcaagtaggtctaagaaacgcttagcagcatcgacgcgaataatattgaggccaaatttaccgcccaacatctccataacctgatcaccttcattcttacgaagaagaccgtggtcaacgaagatacaggtcaattggtcaccaatagcacgttgaagaaggaccccaacaacagacgaatctacaccgcctgacaaaccgagcaagactttcttgtccccaacagtctggcggattttttcaatttctgtttcgatgaagttttccattgtccagtcgcctttggctccacagataccaaacgcaaagtttttcaaaatatcgtttccatatacggaatgacgaacttctgggtggaactggataccgtagatacggcgttccgtgttttcaatggctgcgtaagggcagtcagcagaaagaccaaccaggtggaaatcagcaggaatttcagttacagcatccccgtggctcatgagtacaagctgttcttctggtgttccagcaaaaagcgctgattcagtcttcagttgaagatttgattgaccatattcacgatttccagcctcaccagcaggaacaaccttacctcccaatttatgggtaattaactgcataccatagcaaatccctaagataggaatacccaattcaaagatttctggatcaatatcaaaggcattttctgcgtagacagagtttggtccacctgaaagaacgataccaattggattgatagcacggacttcctcagctgtaattttatggtttttcaattctgaaaagacaccaaattcacgaattcgacgtgaaataagttggttgtactgactaccataatccaatacaataattttttggacatcttgttttgtcatgtttttccctttcgttttgaaaaaaattcaaatactagtagttagtttaacataaaagcgaacattttccaaattttatttgttaaatatctgttttgcaaactatgagtgataataaaaatgttagtgttcgtatttttattgtttttactcactttattttaggtaatctgacttcattgtttgcctaggagaattttaccaatagagtgtggcctgaattagccaaacgcctttatttttggtaaactagaaagaagagaaaggctagataaatgaaagcagcatatatcacaattcacgataaaattaaggaacaaatcgataacggaatctggaaaattggtcaacgtttaccaagtgaacgcgatttagcagatgaatttggtgtttctcgtatgacgctccgtcaaggaatcacacttttagtggaagaaggtattctacaacgcaagattggttccggtacttatgtcgccagtacacgggttcaagaaaagatgcgaggcacgacttcctttactgaattagtacaactccaaggaaagacgccaagcagcaaattattgtcctatacacgaaccaaacctaatgaaaaagaagttgaacaattaggtttatcccgtggcgagtatgttattcgaatggagcgggtccgctatgcagataatgttcccgtcgtgtatgaggttgccagcattcctgaacgcttgataaaaaatgtcccaaaagaagatgttaccaaccatttctttaaaacacttatggacaatggttatcgaattggaacgagcaaacaaactatttttgcgcgtttagccaatgaaaaagtggctcaatatttacaaatttctaaaaaccaggctattctcgcactaaaacaggtatcttatctcgaggatggtcaagcatttgaatttgtaaatagtcagtatgttggggaacgtttcgaattctatttagaaaacaattaacataaaaataattatgtaaaacatttttaaaatccgtaatctttctagtgatgacggattttcttatttataaaatatggaatttttgatataatgaagtttatggaaattgaaaaaaccaaccgaatgaatgccttatttgaattctatgcagccttgctaacagacaagcaaatgaactacatcgagctctattatgccgatgattacagtttggctgagattgctgaagaatttcaagtcagccgtcaggcggtctacgataacattaaacgaacagaaaaattactggaagactacgagatgaaactacatatgtattctgactatgtagtgcgtagccagattttcgatgaaatactgaacaagtatccagaagatgcttatttgaaggaaaaaatcgctattctaaccagtattgataatagagaataagaggagaagtatatggcttttgaaagcttaacagaacgtttacagaatgtttttaaaaatctgcgtcgtaagggaaaaatttctgagagtgatattcaggaagcaactaaggaaattcgtctggccttactagaagccgacgttgccttgccagttgtaaaagactttatcaagaaggtgcgtgaacgtgctatcggtcatgaagtcattgaaaccctgaaccccgctcaacaaattatcaaaatcgttgatgaagaattgacggctgtattaggttctgaaacttcagaaattatcaaatcaccaaaaattccaactatcattatgatggctggattgcagggtgctggtaaaacgaccttcacaggtaagttggctaataaactcaagcaggaagaaaatgcccgtccactcttgattgctgccgatatttatcgtccagctgccattgaccagttgaagacccttggtcaacaaattgatgtacctgtattcgagttaggcaatcaagtccctgccctggagattgtacgccaaggtttggagcaagccaaggctaatcataatgactacgttctgatcgatacagcaggtcgtttgcagattgaccaagccctcatgactgaactaagagaaatcaaagagtttgctcagccaaacgaaatcctcttggtcgtcgatgctatgattggtcaggaagctgccaacgttgcgcgtgagttcaatgatcaactggctattactggtgtgattttgaccaagattgacggcgatacacgtggtggtgcagccttgtctgtccgtcacattactggtcagccaatcaaattcaccggtactggtgaaaaaatcacagatattgaaaccttccacccagaccgtatgtcctcgcgtattttgggcatgggcgacatgctgaccttgattgaaaaagccagcaaagaatatgatgagaagaaatcactagaactcgctgaaaaaatgcgtgagaatacctttgatttcaacgatttcattgatcagctggaccaagttcaaaatatgggaccaatggaagacctgctgaagatgattccaggtatggctggtaacccagcacttgccaacttgaaagttgacgagcgtgaaattgcacgaaaacgagctatcgtatcttctatgacaccagccgaacgagaaaatcctgatttgttgacaccaagccgtcgtcgtcgtattgctaacggttctggaaatagctttgtcgaagtcaataaatttatcaaggatttcaaccaagcgaaaaccatgatgcagggtgtcatgtcaggcgacatgaacaaaatgatgaaacaaatgggaatcaacccaaataatctccctaaaaacatgccagacatgaacggtatggatatgtctgctctggaagatatgatgggaggagctggtatgccagatatgtcccaaatgtttggaggcggtttgaaaggtaaaattggtgagtttgctatgaaacaagccatgaaacgccaagccaataaaatcaagaaagccaaaaagaagagaaaataatctcttcttttttactttttattcgaagaagtaagatatagcaatataaaatagaagtagcaaagcaggaaaaatgattttcaaactccaacactttccgttataacagaaatattcaaaaatgtcctttttagtggacaatctttatattgtccgttataatggaaatataatagaaattagaggataagttatgaattatatcgcaataataggagatattgtcaattcaaaacagacttcaaaccgctctagtattcaagagcggctaaaacagcagctaaatagaatcaatcattccttcgctcaggacttcgcatcgccatttaccattacaaagggagatgaatttcaagccttatgcaagcctaacccttatattttttttataattgaccaaatccaactagcctttcgtgatgaggtggagattcgatttggaattggtttgggtgagattctaacagctatcgatcccaagctaagtattggagcagatggtccagcttattgggaagcacgcaaggctattgacttcattcatgacaaccatgactatggcaccagcaaaattgcattttcatctgaatacaagcaaatcgatcgtgtgattaaccccttgctaacttctagcgatttcatcaaagctgcctggaatcgttcgcaaacggatctgtttgagaccttaatctccaaaaaaatctatcaagaagatttcacacaaaagccaattgctgagaaaatgaaactcagtcaaagcgcctttaccaaacgtttgaaatccagcggaatcaaactctacctgcgtaatcgtcaaactgccatgaatttgattctccagctcagtcagaaagaaggataaagcatgtcattttcagttatttctagctatcttattcaacatccagttttaaccgccttgcttattgcccactttttaagtgattttaccttccagagtcaagcactggcggatgctaaaaagcttcatttgaaagctcttttcatgcaccttttcattgttgctatccctcttcttatcctagccttacttacccctattcaaaacggagatttattttttcaagtttggctgagccatcttgcgattgactatgtcaaatattttctcaacaaacaccattggataaaggactcctgggaagctggagcattcctagttgatcaattgctccatatcatctcaatcatcattctttatcacactatcggtgttaatgtcgcttcacactcactctggattgaaccaaattatctcctcctgcaaatcctttttatccttctgatcagcaagcccgtcaatattcttttcaaactctactttagcaaatatcaggtagcggaaggagaagaagagcagactgtgacaggtgcaggagccttgattggtcaattggagcgcctcataatgggaatttttctgcttctggggcaatacacagctatcggactggtatttacagcaaagtccatcgcacgctatgataaaatatccaaaagccaagcctttgctgaatactatttaattggttcgctatttagtatcatcagtgtcctagtattgtacgttttattgattttataaaacaaatagtttacataatttattttgtgtaaacttttattataaaaatagaaagaaatactatatgattatttggttaaatggcccattcggtgtcggaaagactactttagcaaatatattacacaaacgaatagaaaactcatatctctataatcccgaattactaggtgatttcttacaacatcaattacctcagactgtatgtcctgaagattttcaagattattccgtttggcgacagagtacttataaaatagtatttgatttagcgactaaaaccgataagattattattattcctatgacaatctataagaaagaatattatcaggagattattcagcaattgatacaggataagattcctttggaacattatattttgttagctgacaaaacaaccattttggaacgtttagataatcgagtcaatgaagacaacatctgggccaaaagacatcttgatgattgtttatactcaatgaaaatcaaaatctgactaggcgacgtagatgcagatagaactgaagttcatcaaaacaagtcaacaacgtctgattttgattttcgaagagtattaaaatcttttgaaagtcagattccaggacaaaggtttaaaacagacagtttgaagccagaagaggttgcgaagaagattctaatgctatgtgagtttaccgagaaataatctagatttttaggattttggacgtgaaaaaaattttctagttatctcgaaaactaaaaaattatgaacaattgacctaatatagcctgaacccttgataatactgagatagaagcataaagtacattcttcaaaaaatgtactttatttttattttgtacattattttaggattcaataaggtacaggattaaagcatattattgtattagtgttagaaatccaattgtacaaaatgtagtagaaaatagaggggaggagattggagcaattgtacatttttagatgttagtcgtagagcaaaaataataaaatcagctaatttctcagattttcttgataaaaaacttgacgtatattcaaatatactatataatgaacttgaaatatcaatggccgcccttgcttcaattgcacagacatgttctgatgggtggtttttttgtttaaggagtgttcaaatgagtagtttttcccataaaagttttgaggaacaagttgctttgttagaatcaagaggcatgctgttttctggagagcaggacaagaaaaaagctgagcaaaagttatcaataatttcttactataaattaaaggaatttgctagacctttttcaaaaattgtgacagttgatggagtgcgtcaaataaattaccaaaacaccccattcaaaaaaattactgttagatattatcaagataaacgattgcgtctccatctattggatgctctcgaagacattgaggtagctttaaaacccaagtagcatttgttttaggttataggagattagggccatatggatatttaaatttctcacagtggtgcaataaaaaagagtactgcaagcattacctaaaatatcgagaagagaaatttaaaaagcagctcaaagctgaattgaaaagaacaacttctccagaaatcaaggaaaaattgaaaattgacaatatgaaatatcctccaatttggttggctattaacctaatgacgttcggtcagataatcaaccttatcgaattgatgtcaacaaataatattagacaaatagctaaacaatatgattgcagtgatgctgagttactttcttggttgaaatgtttgaatttattacgtaatatgtgtgctcataattcgaatattattgatcttaaaatgcatacaacaccaatacttcgtgaagaatggaaggagctcttatacgaactaaaagaaggtgtttattcaaaccgcattgctctgccgattattatagtgaaatatatgatggatgctattgataaccaatataattttagagaaatttttggttcatttagaaagttgattgacaaaagccaaaggcaagcaaattactacggccttaaaaacaaggaagtattgaattgtctgcaacataattctttgtatactagaatttgaaattagaataatctttgtttgctaaatattaagtagatgcattaaaaagtcactcatattaagaaataataaaacaggtctaaagtatagatctgttttaaatttatgtaaaaaatgggggtatctctatgtccgaaaacatagttttaggtatcaaattaactagaaaaatgtactttggaaaaaatttccagttttgtcgttattaaagtacatttttagctgatttttcctaaaaaatttttttggttatctttctaatatccccacaaacatttttccgaaaaactataattttcttgaaacttatataaggttatgctatactactcatataactaaaaatcaggagaaaatgatgagacgcgagttattattggaaaaaattgatcaactaaaagaaattatgccttggtttgttctggaatattatcagtcaaaattggctgtgccttacagttttactaccttatatgaatacttgaaagaataccgtcgtttttttgaatggttacaggattcggatttggtggctgttgaacggattgctgacattccgctggatgttctggaacatctgacaaaaaaagatatggaagctttcattctttatctgcgggagcgtcccttgctgaacgccaataccacgcagaatggtgtgtcgcagaccaccattaaccgtaccctctcggccctttctagtctcttcaagtatttaaccgaagaagtggagaatgagcagggcgagccctacttctaccgcaatgtcatgaaaaaggtatctactaagaagaagaaggaaaccttggcagcgcgggcggagaacatcaagcaaaagctctttttgggcgatgaaacgatggagttcttggactatgtggacaaggaataccaagtcaatctctctaaacgtgccctctcctccttccagaaaaataaggagcgggatttggcgattctggcgcttctcttggcttctggcgtccgtctgtcagaagcggtgaatttggatcttcgagatgtaaacctcaatatgatgattatcgaagtaactcgtaagggtggtaaacgggactcggtcaatgtggctgggtttgctaagctctacttagaagcctacatgggcatccgtcagcaacgctacaaggctgaaaaaacggatacagccttcttcctgtccgaataccgtggtctgcctaaccgtatcgatgcttcttctattgaaaaaatggttgccaagtactctgcggacttcaagatacgcgtaaccccccacaaactccgtcacacattggcaactcgtctctacgacgccaccaagtcgcaagttctagtcagtcatcagctgggccatgccaatacccaggtcaccgatctctacacccatatcgtcaacgatgaacagaaaaatgctctggatcagttgtgatatcacgtaatataaattatgtaaataaattaaggagtaagcgaaaacttacccctttttctcttaaatctaaatcaatgctttcaatttttcctgattgactgctgggtactggtccaaaaaggctgagagagttcgtaaaacggcaggtatgtgtccagtctggtcattctccacctgcaagaccaagagcggctcgtggaggctcatacggagcaagagccagccgtcaccataaggctcagtcaggtcaaaccgcactccttcttcgttttctgggttaaaagcaaagccttcgaggctggtttggcggaggtcagcaatgacctgttcaccaagcgctcgatagtctgtggcttccagtttgaaccgcacttcttgggtttccaagggttgcttgagctgggcaatcaagtcgtccaaggacttgccttccgcttgcagtttgggtaagagcatgagaatcttagccgctacatacgttccgtcatcgaggaagtaattttccttaaaggcagcatgtccagatgtttcgatagccaactggcaatcaactccttcttgattggctaaaatagcacggtttatgacattacggtagcctgaaatatagcgaatttgtttgcctcccagactttctataaagaccttaaggtgttcagtcgttggggaattggtcacaatgctggttcctggatgttcagctaggacaatctggctgagaacggcaatcaggttgttacgattgagaatttctcctgacttggtgaccagggcggcacggtcaacgtcggtatcaaagataatgcctaggtctgcaccttgcttcaagacagcctgacgaatgctttccatagcttccttgttatctgggtttggaacatggtttgggaaggtgccgtctgggtctaggaattgtgaaccagtggtatctgctcccaattctgccaacactttctcagcaaagaatcctcccgcaccatttccagcatcgacgatgatattaagacctgtcagtggtttttcttgtccaccacaggcggtacgaattttaccaaccagatcttgggcataaggcgtaatcaggtctgcactggtgatacttccaagggaagaagctggcaagtcttcactatgcgagaggatgaagtcaatatcttcatgttctgctccgccattttccgaaaaaatcttaatgccgttgaagtaatagggcaggtggctggcagtgatcatgacaccagcgtggcacttgaactgcggatactgggtgctcatgaagagagctggcgtggtggccatgccaaagtcaatcagctgaacgcccagacaaacggcttcttctgtaaaggctgcgaccaaatctggaccgctgaggcggctgtctcgaccgataccgatggtcaattggcctttttgatagacctgcgccagttccggcttctgagttagccaatgaataagtccgcgaactacttcctgggtggcttgtggagtgagattgacagcatattcgtctgtagcgatagcaattccacgaatatctgatccattttgcaagacgtgatgatgggacatagtaacctcctaattcaaactaaatttagtatatcatattttcgaagcggtttcaaaatgaaaaaagcacagcttctactgtacttttgtaatgcttacagttgtcccaatttccagttgactttccacggaaatagctagttccaactgattcaagacccgcttggtcagatacaatccaaatcctgtcgctttttggtgttctcgtccattaaaacctgtaaatccctcgtcaaacaggcgaggaaggtcttctgccagaatcccaattcccgtatcgaaaatggaaattcctccattcaattcaatggccacctttccaccagtcttattgtacttgagggcgttgtcgataatctgtgatagggcaaaactaagccactttctgtcggttttcagtagccaatttccatcgataatcactgaaatgtccttttgcaagaactgattgcggtattttttgaccaaatccaccaccacttctcttacttccacctgctcaaaacgaaaatcactgacatggttggtcagcttgaggtagttgaggagattggccatgtaattatccaagcgtaagagctggtgattgacatcctgctggttgagattgtcagtctggctcatcaaagacagggcagccaaaggcactttcatttggtgggaccacattttgaccatagcttgcaggtcttcttctcgtgacttatagaccaaaagctgctcccgtgtcgcctccttctctgcctcaatcaagttgagataggccaagtccacaggcttattaagcaggggcagagcttcttcatggacatagtcttccaaggctctcatgcggttgcgaaacttccagaaaagccctacagttagaaggattaagaaggttagggacaatagcagagcgttttgcaggaattcggtgggcagttgatagagaaagaagagcaagataaaactagtagccagaacaatgtaggagaagtaaaaactccggtattcgcggataaattttgctatcatttgatcaagtaccccacgccacgaacggtatgaattcgttcaaacccgacttcgctcaccttcttacgcagtctggtcatgtttacattgagcgtattctggtcgataaattcttcattttcccagagtttttccaagagttcatccttgctgacaatctgcccttgtctttctagtaaggcggataaaatcttggtttcagtaggtgaaagctgaacctgttccgattcgtttgaaaatcgcccgtccaaactaagctggaactgatcgatagacaattcgctcgatttgctgaattgattaacccgacgcaggaaggctccgattttggcatccaaaattcctagagaaaatggcttggagacaaaatcatcgccacccatgttcatggccatgaccgcattcatctcatcatcgctagaagagataaagataatgggcatggtcatggttttacggatttctgtcgtccaataaaaaccgttgtaatagggcaagttaatgtccatcagcactaagtctggtttgatttccgcaacttcctgactgacagctcggaaattctgcacactttctacctgataagattttcccaaatgctgcttcaagagttggacaatcatctcatcatcttcaacaatataaatcttctcttttttcatcttcttcattctgcaaaagccaggacacaggtcttggcttatatacttccatttctcatttttatgcttgtcacaatcaatttatcatcttcaatattaacgataaccctgtaattgccgatacgatagcgccattggccagaacgattagcagtcaaggcttttccgtattgtctagggttgtcagtcacatgactggacaagtagttggtaatctgtttttgggtaaatttgtccaactttttcaactgtttaataaaacgactggtcggtacgagtttataacaggtcttcatccgtcaaccccaactcttccaacatttcctcccagctaatcggctcaatgcctttcgccaagtctgcctcgtattcagacagagcgatatctgccacacgggcatcatattcatcttcgagagcttcaagggttttagtccgaatgagttctgacaaactgacaccttcaaactttgccatagcctgcataaagagcttgtcctgctcagaaactttcaatgtaatagctgccattttctcacctcttcgagtattcctttggtattaccattgtaacaccatttccctgaaaaagcaagaaatctcgcacaaggcgagacttctgctaccgttcaataatgcgataataagtgcgactagtccacttgtaaatgacaaagtaaatcagagtgactgccagtagggtgatgccactgactgtgtaaatcattagtgatgaggtaacaccaaaacttagtagcatttgcttgagcatgataagggcgatgacaaagtgtagggtcgccatgaccaaaggcataaagaagaccgtaagtgtttgggagttaattgttttcttgacagccttctggctcatgcctacttcttgtagaatcttgtaggatttcttgtcctcatgcccttctgaatactgcttatagtagataatcaaggctgcacccagtaggaaactaattcccagcaagaaacctgtaaagaggaaaccgcctgtaaagcccatcagtaaattgttgaaatccgtacgttgcataacatttccaagatattctccattttcatcgagaatttcgtatatttcaccagattgctctccaagagagagtacctcttcatcagtcaagtcggtaaagacacgataatctaggctaacaagatagccttgcggattattggattcgtaatactcacgaacagcattcaacactgtgtcatcactgactaccataacggcggcatttagcgtattggtgatgtctgggaaaatagccttatcaagattggctacattctcaaaggattgatcgcccaaaacaagcttcttcagcgatggtttttcgctcggacgcataaagaccacttgattggcagcaagctctggcaggtcattccccaattttctgaaatcatcttgggtgatgaagtaggtaaaggccattttagaaaaatctggattagaaatattttttgggctaatgacaatctcttcgccaccatcatataccagaccagcttggtaggtcagataggatagactgtcatcggctttttctggaaaatggctgagcaccgattgctggaaggccatttcaccttgacttctatccgaaactttataggtaatagatgtttccttgggatatagtgcacctgtcatactgctcatacctgtataaagggaggttgtggtcgcaatggtcacaaaggccatgaccgcaagtagcgtaatattggccaaacccgttgcgtgctgcttcatccgaaaaatcatctgcgatgtcgtaatgaaatgctctggcgtatagaaataccgcttgtttttccgacgagccttcaaataccaagtcataaaactgatgtagaacagataggtccccgcaatgacaaagagcacagcgataaagaaccgatagataacagctagaccttctgctttcgatgaaagcgataggtagtagcccatcccaagactaaaaacaccaagagcagctagaagaacatttcctttcggctctctctctcctttttcactagctcggaacaaaatcagcggactggtcttgccaatggtccgaatggctagcaattccaagagaaagaagaaaccagcaaagagaaaggcagtcatgacaaaggccagaggctcaattccaaaatgtaaatcactataatgtgttatattgacaaaaatcaagtagagaacatttgcaaacacaccagctaaaacagaaccaagaaccacaactagcaagaaaatcatcatcaattcgaggctagctatcaaggctacttttttcttgttcatccccagcatgttatagagaccaaattctctcgcccgttgtttcatcaggaaattaaaactataaatctccataatgaccgagaaaatggtcagaataatcacaccaagaccgatagaaatggcaccagagcccatggtcttcataactggactcagcatgatcaagaacatggaacaaatcagggtaaagaggaccagactggctaaaacgaagggagcaaaaacacccatggattttcggatattttgcccagcaagtttgaggtaaaacatctactcaccccctaaaagtgcagacatattgagtgaaatctccttggcaaagtcttgattgctcttgtctgccttgtacagttgatggaaaatacgaccatctttgataaacaagacacgtttggcgtggctggctgcgttggccgagtgggtcaccatgagaatagtttgcccgtcacggttaatctcttcaaacaaattcagcaagtcttccgaattgcgataatctagggcagccgtcggttcgtccgctaggacaatctgtggctgggtaatcaaactacgagcaatagccacgcgctgcttttgtccaccagaaagttcaaagggacgttttttcagcaaatcttgaatccgtagttttggtgccaatacttccaaccgtttctccatttcctgatagctctcacgtgccaataccagaggtaaaaagatattgtcttggatggacagggtgtccaagaggttaaaatcttggaagacaaagccaagattacgcaaacggaaatctgccagcttgctttccttgattttggtgatgtcttgattgtttaagataacagagcccctcgtcggcttgtccagggttgctagaatgttgagcaaagtcgtcttaccagaaccactttcccccatgatagcgataaactcgccctcttctaccttaaaatccacatcttgcaaggcacgagtttcctcttttgaaaagcgcgtgcggtaaactttttctaaatgattgatttctaataacatagttactcctaattgttttctttagcaaaattaacttgatttagtatagctaattttctttggtactaaatcccatgaaattgagtttctaattatcagctttataaaagaaatacatgaaattgtaaaaggtttttatttactattttccaaattcttgatagttaactgataaaaaataaaactaaacacaatattcactgtaataaataagataaactctaaaaatgtcatatcttgcaatgccctactccgtaatccaatcatcggttgagagtaagggaaaaatttcgtaaaactttcattgataaaaattaatacaaaattaagcatactaccaatggtagcaacaccgactcccttactgaaatttcgagtttttacagtgatataggattggagtgtaataattggaaaggaagacaaaagcgataaagcaatccatttaacatgtgtggctaaactaaggtcaaatgaaatgccgtcaatttttgccgcaactataaaaatcagcagcaataagagttgaattggaagaataagaagaaaactgctcattaattttcctaaatataatttcctcatagaaacttgattagcctttagcatgtcaagagtttttcgctcaaattcaggaactaataagagacctgcaataatggctaacataggaggataaagtaaggtactattgtaaaaggtcagttgtccccacagaaccaaagattgagttccgtcgattaaaacatcacgattagcaaaatagatacccaatcctatcatactagagaaactcaaaaaggcaatcccaatgactaataattgaattttccttgtttttgtccactcagctaagaagtaatctttcatcttagttccctttctttcttaatattagaaccgccaaaaggtagagtatcaagcagtaaatggcataacagacgattttctcaagcaactgactatctaaattataggtaattgtgccgtcacccagaaattgatatttataaggcgcaagacttcctgaaccagtgattgggttaagtaaactggtaaaaccataactttttgggtttaagataattcctagaaaaccacctaaaagtcctagtgctagcagaatcccctgcttttcaagaatcatggccaaggtcagataaagacaaatcaatgaaaatattgcaagtatctgcccaataaactgaataccaataatctgcaaagaaatagagattcctgcctgtgttccgaaaagataaataatcataatttcgatagcagacataataacaaaggaaaccagcataaaaaagaatttatcacgaaaaatggctgttaggctttgaccattagctatttgtagtttaaaggtctgcccttcatgttcattccctacaattcgactagcaaacacacaaactgcaatcgggaacataagtagattgacattctgattactaaacaaggttccagccattcttaactctggatgtgaagagaaagcagagataaaagttgcaatattccaaagtgtggcaaccaacatcaaaataatgacaattgaaatagattttgttcgtctactttttagccattcaatgtaaacaccattcatcttacgcctcctttgttagatttaggaaaatatcttcaagagtttcactttctctaaccactcggaatattcggtatccattttctattaaatagctcaccagatctgctaaccgatcgttatccaaatcccttaaagttacttgactttcggatgcactcaaaatttctaccgttccaagttcaactaaggtctgaacaatatttttctgtgaaaaatcaccgccaatttcaatccaagtatttgacttaatagcttcaatttctccctcatagacaagacgaccatgattgataatcccaactcgatctgcaatgtgttcaatttccggaagaatgtgactggaaataaagacagtcagacctttttctttggctaattgaacaattaattcacgaatttcatgaataccagctggatcaagaccatttgtgggctcatctaataataagattttcggctttttcactaaagcaaatgctaaggcaagtcgctgtttcataccaagagaataggccttaactaatttttttcgatttttttcatcagctaatccaacgagctccaatgttggccggatattatttttatcaaatcccaccattttttgaaacactaataaattttcatatccagttaaattaggataataggacggttcttctatcatagatccaatctgatttaggtattttttgtcatttcgaatgtcttttttattaataaaaatttcacctgaagtcggagtgacaagtgatagaatcattttcatcgtagttgtcttacctgcaccatttggtccaagaaagccgtagatttctccttctcgtacagtaatcttttcaatatcaacagtggtaacgtctttgtaaactttttttaaatgattgatttctaataacatataaactcctaattgatttcttaagtaaaatcaacattctcaagtacactttgatagtcgattcggtctgattcagcaacattttcttctaaatctaccttatagtaaccatcctggacaccgatggcccattccttgttagtggttacatagagattattcaaggatactgtctttttcactgccccttcttctttgacaacaggccattccataaactgaacttctgttccttgaatactatcttcggcaacttcctgtttgctaacggcatagacttttcccttgtaatggaaagtttgatagccctcatcaaagctaaaacctgctgaagaggaagagcaagcagttaggattatgcttcccaaagccagcatgctaattactttctttttcatagtttcctccctctagtatgccataaatcgcatactttgcaaattatgggcgagctcttctaagaataaggcttgttccatgagttcagctttctctttttcagagaataccttttcttctattctctttgcttgtagaaatttgaatgacatatgatttccttctttctatttcttatgagtctattatagaaaatattcctcctgtactctcttacagttctgattaaaaaacttacagctttgtaaggaaagaataaaagacaccatttctggcgtcttacagttagttttattttgttagaccaatataagcaatcatttcatctaactctttcttgctttccgttacaagaagataggcatcatttccctgaagttccgcaaaggcatctggcatccgtttgactgtcttaatcttaccagcgaatgtctgatggatatcatctgctgagtgaacatattcggtcgtatcacggcgggttgctaccaagcagtattgtggttcaaatctacgttcctcaactgtaccacctgttgcgacattggcataatcacggaaaagatcaatggaatgagcgtagttataggcttcaactgtgaaaccgcctgccatacggttattgtattcaatggcaatgtagtcgtccccatccttgaaaaattcaatatggaaaaaacgctctctcataccaaaggccttgataatagctctgccatactcaaccagtttaaaatctaattctttttcgataaagtaggcattgtccttcttggtttgcatcaattcaaatggagtatgaacataagtcaagcctgtttcaaagacaacattgccttcgtagtccaacaaaccatcataagtagtgataatacttgaattgacaaatttttcgaggaaataaatagttgctccatcccatgtctccacaaaccgatcaaaatcttctttattttcgattttgaaggcacctgatgctccaacaccgttgtctggtttagcaatcattggaaaaccaacattcttcaaagctctgccaaaatcacgttccgatttaacaaccacacctggaacaactggaacacctgcttttttgaaatattttttcatttcagacttaaatttggtctttttcaggtgtttaggcttagcaccaaaaatgttgaattgttcacggagggctgcatcgttttcaagccaatattcattgtgggattctacacggtcaattggaccatgcttgtaaataagaaaggctgctgcacgcttgacttcatccaagttttcaagattctcaacacggaagtattctgttaaggcattacgaagttcttcaggcaattgatcgtaaggttcttgcccgatacctagaaccgtaacgccttctttttttgccaattcaatggtaaatggttggaaattttctggataaaaaggtgaaataacgagataattcataggtagtcctttctagcttatagtccgatagaatgaaggaagaatggcatttgctttctccaccacacccagtcgtgggccacatctgttccccaagtatcaaaccaagctgggatactcttctcttcaaatgcacgtttgaggttatagaatgagtccaaaccgtcttgctcccaatcgcccaaacctgtacagacgataatatcagcctgacggtatttatcaataaaccagccgtcgttttggttccaaatgtaatctgatggtgagttctgataaacaacatcatcattgccataatcttgattgttgttgaagaaacgagcatcatagacacctgaaagggcgataactttcgtgaaaacatctggatgttgcaggaagaaattgagcgcgtgataagctcccatagaacaaccagttgtcatcatcccatcaaaccaaccagttttatgtttgataaagggaatcgcttcttcaatcacataacgctcataggcacggtgagcctctgccttgtcatggatggatttccagtctgccaaccagctttcactatcgtagctagttagagtaaaaaattggacctgaccagcttcaatagagccacgacaagcttcaatcataccaaaatcagcatattcattgtaagaaccacctgatgaagcaaatacgacaacaggaatccctacgtgaccataacgatttagattcatttctcggccaagatttccagaccaatgacttaaaaattcaacgtgcatagtaaagcctcctatttgtatatttttgttttatgaccaatgttcgcttaggaatcgtaggcaagctggcaaatagagcgcccaagcctcttcattatggaccgcacctgaaacgacttccaaggcgatattgtccaaatccactccgccagcgatcaattgacgatagtaagtcaatgaagaattgatataggcctgcttgatatttcctgccatcaatgttttatctgtatcatctgcttcttctgtcccaacgtagatgtagactcgttgctctgagtctaattgttgacgttcaatataacggtcgaaagcatcttgatgaagccagttggcagatgaaaatactcctagacagccaatctggttctgataagccaatcccataaactgggtgatattgcctcccaaggatgagccaatcattgcagtgtgaactttatcagattttgtccggtattcttgatcaataaatggtttgacgacatccatcacaaattcagcatacaaggttcccttaccaccgaactgcaccccaggaatccccatctcactaaacttccaagcagcgtattcatgcatgcgatcagcaccatcgttatcaatagccactacgatcatttttgcaatgtctggattacgcttaatagttgggatgactttccatgaatgacctgaaaaagcttccttactgtagagtacattttgcccatcgtggaaataaacaacgggataggtctcttctgtattttcagcatatcctttcggcaataaaacacggactcgacgttttctttctgtaaatggtacatctaattcatgagttctcatgtccaaataaaagtaagacttattcatatctatctcttccttacgtattttaagtattatatcatagtttttctggaatattcagaaaatttagttatttatttgcaattttcggattttccgaacatagttagtcaatgtcacagaattttctcatacatttggcggtaataatctaattctttttcttctttttgggtgatgctttcaaaaatatctagcaaaatggtacctttatcacgtttccaggttgccacaaatcgccctttataaaatacaacaggtttgacaatacccgtcaacgtataaatgttacggatgtattttggatcgaaaaatgggttgtttttcttttcatagcccaaaagtaattgatcaaacccagcaacgaaaagacactgaggtaaatctgcctcatcaagcaccccaaggtaaaaccgctcctctccagctacttgaattgtttttaaatctaattgagccatccactctagaatggttgacttattttctttgaaataataacgagcatctgctagactgactggcccaaagcctgaaaaataccgacgtgctatttccagctcagctttttcccgagaaagtggctgaaagtctgtcagacgatgaaaacgcttggcaccgtactcttggtagacttccccacgctcgaccatgtagcgaaagagaccgccccaggcattaaagaccagcttctcctctttctgtgtcatcttttcctctcggcaaaggaccttgagatcctcacgggtcataggaccttgttcaagggcttctaaaatcagatggtgatatttctgcttggtctgaggactaaaaccgtcccgtccttctgtcttgaggtaatcggtgctgaccagccgcccctcatggatatagagaggaatttccgactcgagataggcatgaaccgttcgccgaatggaccactgacgagtcagttcctcctgccagctaccctcatgaaaatcctccgctgtcatacggttacgaaatccgacatgaacatagggctgaaactgagcctgcaaaccattgagattttggcagatttgttgaacagactgggggttcaacagaccttgtttctgcagaataattcccttccaagtattgtggtgcatcgtatttctcctccgctttctaatcccagtataacacaaaagacacccgaaggtgtcctgtacattatgctttcacaatgggaatccagagttccatttggtagtctggggaactcatgtctccttcaaaatagtactcaaaatctggtgcacctgaatggcgatagccgtgttcaggaaaaaaagtttctagcgcataacgccatcctgcatgaatagattgaggaacagggcctgttagggtaaaaatagcatagtcagcttcgtgaacatcaagaagttctaagcctaacttagtcgctttttcactatctgtgacatcataagcagccatataattaatcgtctcgtccgcttgagctaatgtacaaactccaaaggactgcccacttcctagagcagctaactcttcataagtatggttcttgaacaagtcttcccatacctgcggacacacttcgttactgattgctgtgcgaagaagtccagcaactgtaaaaccagccttcttttcaatacgaacatccatttctttacctccttggatggttaatgatagttgcaagggtaagaggaccttaaaaggcaaccccttacgcacttgactaggagaaatctgatgaaattgtttgaaggcaaaggcaaaagaatccgaagattcatacccatatttaagggctatatctataatctttgcctgtccttcacgaatgtccatagcagctcgcgtcaactttcgtaaccgaacgtattctgacaaggacatatctgtcagaatcgaaaagagacgactaaacatgggaacggaatatcctgatatgcgcaaaaattcccgttcatcgatttcgctttctaaaacggactctaggtaacgtacggttgcattgaactcttttatcatcaacttcccctttccctatcagtttaccatctaccatccaagttttcccgatacttttcgtcggaaaactatcggcttaaaccgtcaaaaactcttccaagtccttgagggaacgctctgctattgcctcataacgctccttcttatcgcggatacgcggtccgtccagctccttgatgataccaaagttgacattcataggctggaagtgcttgctttcggtgtgggtgatgtaaaatggcagagctccgatggctgtggtctgtgggaagatgactggctcttcgccatggaaacggcgaacagcattgataccggctactaagccagaggcggcagactcgacatagccttctactcctgtcatttgacctgcaaagaacaaatttggatttttcttggtcgcaaaggtctgttccaataagtttggcgaatccatgtaggaattgcggtgcataacgccgtagcggacaaactcagcattttcgagtcctggaatcatctggaagatccgcttctgctcgccccacttaaggtgagtctggaagccaacaatattgtaaaggctacctgctgcgttatcctgacggagctggacaactgcgtaaggtgtcttgtattcgccatcacgtggtcccttgtaatcttctggatattccagaccaactggcttcattgggccatagagcatggttttgataccacgtttggccatgacttcaatgggcatacagccttcaaagtatttttctttttcaaaggagttaagcggtgcttcctcggctgaaatcaaggcctcatagaaagcgttgaactgctccttgttcataggggcattgagataggcagcctctcccttgtcgtaacgagacttaagataaaccaagtccatgttaatggtcgagctgtcgacaatcggtgctgccgcatcgtagaagtaaaaaccgtcaccaccattaagcgcgtgaatcttctccgccaaggcgtcagacgtcaaaggccccgtcgcaatgactgtaatagcatcttcaggaatttcggtaatctcaccacggatgacctcaatcagcgggtgattgtgaatctcatcagtaaccgcttgagagaaattctcacgatccatggccatggcacctccagcaggaacacggtgagcctctccagcacgcatgataatggaatccaaacgacgcatctcttccttaagaaggccgacagcgttggtcaaactatcaccacggaatgaattggaacaaaccaactccgcaaacttgtccgtcttgtgctgaggagtcggcttgacaccacgcatctcgtagagtttgacaggaatgccacgtttggcaatctgataagcagcttctgagccagccaagccagctcctataacattaatgtgggtttgagacatgaaactaatacctctagccagaatatctgactactgtttgggaatacccaaaaacagaacctttctaaattttatacctatctagtataccagaaaatggctagaaaggacaaaactaccttcattgaaatgaaagtagtttcacctttttacataatatattttatgtatatcctttactgttctatcgcttatttacaatagctccgctatatctccaacaacctcaaaattccaaccaagtctcctataagagtcgatttcttcctgactatacgggaaagtattcagcaaaatggaatccattcccaattcatgagcaatagctatatcggatgtcaaatcattaccaaccataaccgtttcctcaacatcaagattattttcctctaaaaccagttgaagaaatgctggttcaggcttcttcatcttaaagtcagaagagatataaattttttccatcaaatcagcacaacctgtctgttcaatttctgcctgagtaaaaattcgttgagcattggagagaataaataatcgcacttctctgtcctttaatgtctgtagactagttagggtattttcataagcctctaacttttcacgtgaaagcacgcggaaaatcgtggctactacttgtccaaaagtctctaaatcagtcggcttattggtactttggttttcatttggtgcatccgttaatagacgaatgaagattgtttctaaatcaatttcgacatactgataactcactgtttccgcgagagagctctctgcctcttctacaaaacgatgataggcatttttcaactggcgcggtcgataggaacaaccaaaagcattgtaaatctgtgttagctgattccagacctctagtttattctcatctgtacgaatatcaaccaatgtaccataaaaatcgaagatatagtttttgtaacttttcatgtctttctcctaatctttagacatcattttttatattataccccacaacgaaaacgtttgcaacaatagaacgaaaaaacctaccacattaagtgataggtttttattttgattggaaactctattatttaagagtaactgaagcgcctgcttcttccaatttagctttgatttcttcagcttctgcagttgcaacgccttctttaaccatagctggtgcaccgtcaacaagctctttagcttctttaagaccaagaccagtgatttcacgtacaactttgataacgccaacttttttgtcgccagcagatgtcaattcaacgtcgaatgaatctttagcttcttcagcagcaccaccagctgcagcaacagctacaggagcagccgcagttacaccaaattcttcttcgatagctttaacaaggtcgttaagctcaaggatagtagcttctttaatttcagcaataatgttttcaatgttcaatgccattgtgattttcctccaatttaggtttttaaatagtttgtagcactaagcagctacgctctgacgcattaagcagcgtcttctttttctgcaacagctttgacagcgtatgcaacgttgcgaactggcgcttgaagtacagaaagcaacatagaaagcatgccttctcggtttggcaatgtagcaagtgcttcgatttcttctttagaagaaactttaccttctacagcaccacctttgatttcaagagcatcagcagttttcgcgaaatcgtaaattgttttagctggagcaactgcatcgtttgagaatgcaactgcagatggacctacaaacaattctgcaagaccttcaagaccagcttgctcagcagcacgacgcaagattgagtttttgataactttgtactcaacttctgcaccacgcaagttacgacgaagaactgtatcttgttctactgtcaaaccacgagcgtctacaacaacgatagatgttgcagctttcatttgctcagcaacggcatttactaattccgcttttttagcgataatagcttcactcatttttttacctccgtttttattttgggctaggcacaaaaaaatcgcacctaaacctagacacgaaagtacaaatacgtttatctcaataatcgttttgtgcctcggtaggatgtttatgagtccagctcccctactgtcttaggtcagttttttcaaacctcaattatcataacacagtattttcaataatgcaagacttttctcctatttttttaattttttaaacaatttttcaaactggtattgccgtttagttcgttttagttgtagaggtcagacttggaatgtgaaacacgaattgctgtgatttgcttcgcaaatcttatctccaacctttttacctcgattttttcatttctaagctcaggctgaaacagttcactgaacagtttcactccactggcctgttaaacccaatcaaccactgcactgagaagtgactttggactttttgaccagcctcatttaaagttgaaaataaggaaacgaagtttcctcgcttgtcgaagtaagctaagataaactaacatgactataaaaaacaactgccattcccttgagaatagcagtttaatcttatttaatcttgtcttcttcgtagtcaccatttggacagacaacttgtttaccaccaccacgaacttttttctcgacaagatagtggtcacattttggacaggcacgaccaacaggtttatcccatgaggtaaattcacactctggataacggtcacaaccatagaaaagtcgattgcgtttgctctttcgttcaatgacctggccttgttgacacacggggcaagttacgccgatctccttggtaatttgcttggtattgcggcaatcggggaaattactacaagcatagaattttccaaaacgacctagtttaatgaccatttcatgtccacaaacatcacagtcaaagccagctggttcatccttaatttggattttttccatctgttcttctgccttaaataattctaccttgaatggctgatagaaaccatcaatgaccttctgccactgctctttcccgatttctacatcatccaatttttgttccatatcggctgtaaatttgacattgacaatatctgggaagaattcaacaatcagcttattaacgatttcgccgagttcagtcggttcaaatcgcttagcagctaacttaacatagtagcgtttctgaatggtttcaatggttggtgcataggttgacggacgaccaacaccattttcttccaaagtcttaatcaaagtagcttcagaatagcgagctggtggctgcgtaaaatgttgttcaggatttgttgatgtacgtacaactgtatcaccttgctccatatctggcaacatcttattcttgtcagaatcattatagactgccatgtaaccatcaaatttaacttggctaccattggcagcaaaaatcactccattttgacctagacgaacactcatggtatcaaagaccgctgcagccatctgacttgcgacaaaacgattccaaatcagtgtatatagtcgcaactggtccttgtccagatattttgcaattgattcaggtgttaagttaacatttgatggacgaatggcttcgtgggcatcttgtgcaccactggcattttttactttattaccatgctttgaataggtagcaccaaaacgctccgtgataaagtcagcagcttgtgcttgtgcaacagggctaatacgtgttgaatccgtacgcatataggtaatcaaaccttgggtaccacctgtgccaagactgacaccctcataaagttgttgggcaaccatcatggttttacgagtacggaaattgattttattagccgcatccatctgcatagtagaagttgtgtaaggcagaggtgcatttcgtttgcgttccttacgctcaacctgttctactaagaaatcatccccatcaagtcgggcgagaatttctttaacctgctcattgttttcaattttagttttctttccatctataccgtagaaagaagcctggaatttcttgctcccctttttgaaggttgcatcaattgtccaatattcttctggtttgaaattgctgatttcattttcacggtcgattattaatttgagagcaaccgattgaacacgtcctgctgacagaccttttttgactttcttccataaaataggtgatatggagtaccctacaatacggtctaagacgcgacgagcttgctgggcatctaccaagtcatgattgatagcgcgcggctcctgaaaagcattttttactgcatcttttgtaatttcattaaagacaacacggtttttatcgtttgcgtccaatcccaaaatgtgagccaaatgccaagaaattgcttctccttcgcggtccgggtcactcgcgagaaagacttgcttagcattttttgcttcttttttcaaagaattgatgagtggtccttttccacgtatgttgatgtactcaggtgcatagttgttatcaaagtcaatagacatactagatttcttcaaatctcgaatatgcccgactgaagcaacgaccttataatttttaccaagatatttttcgattgtttttgccttagcaggtgactctacaataacgagatttttcttggttgttgtttttttcttactaactgtttttgtagccattcttataccttacaaatatttttaacctcacaaagaatatactatttttcagtcagtgtcaagatatttattttcctataggaagacttgttttaaaattgatactcagaaatgatgtccaatcctgatgtaacgcactttgctccctcttgaatcaaatgatgacaaccatctgattttccgtccataatggaacctggaatagcatagacttctcttccttcttccaaggcacgttcacaagtaatcaagctgccagaccgcatttttgcctcgcagactaccaatccttccaccaaaccagctataatgcgattgcgttctggaaaatggtatttgagtggctgagcaccagcttcatactctgtcagcaccaaatggtgttttccaatataggtctgcaaatctttattttcttttggataaatattatctaaacctgttccgattacagcaatggtttggcctccatttttcaaactggcgatgtgggcagctgtatcaattcctcttgccaaaccactaacaatgacaaaacgattgctcaattccttgataattttctgaacagattggataccatttttactggcatttcgtgtaccaacaactgccagctttaatttttctagcaattctaaatccccttgataaaacaaaagtacaggtggattgtaaatctgtttgagcgccaaaggatagatgtcatctaaaattgaaaatgatggatacttattaaattcctcgcgacaggcttttgtatctagattcttataattttccataaatagcactggatttttacattcagacactacagcgacatttcgcaaggtcaattttttaccgtgtttttcttgataggccaaaactttattcacattaagattggtcaaacctgcttttttccatttaaacaattcaaaattattcattttcttcacctcatctagtctattcgcaaggcaaagaaaaaattctcccgaagaagaattattttttaggtatttctttgataacacgcgcaggattgccagccaaaacgacattatcaccaaaagacttggtcacaacggaaccagcaccaccaacaacattgttgcccaaggtcacgccaggtaagattgtcacaccaccaccagcccagaaattatcaccaatggtaataggagagccatattccaaaccagaatttcgttcatcaggatctagtggatgaagtggagttagcaactgtacattgggaccaagcatggcatttttgccaatggtaatgggacagacatccaacatggtacagttgaaattagcgtaaaaatcctcaccaacatgaatattgctatcgtagtcacagtagaaattgggctccatatagatgcgttggcctgtagttccaaaccagcttttcaatcgctcagagcgggcttttccatctagttcttcgttaaattttttcatctgttggcgggcaaaggttcgcatctttctcaattcagcatctgctgccatataaaattgcccagctatcatcttttctttttctgtcgacatacccctactcctatttttttatgattaaattgatagcttgagcaagacgagcttcttgttcttcagggttttcagatggatgagtgatacaatcttgtaccttctgagcaataaccattcccatcatactattaatgctggaacgaacagcactcaactgagttacaatatcaatacattcctgatcttcttcaatcattttctgaatgcctctgagctgaccttcggcccgtttcaaacggtttatcatctttttcttatcagtattcataccctatatggtactgcttgaagtgaaaaatgtcaattttttaccttgacatctttcgaattccttgatatattttagataccctgtagggtataaaggagtaacaatgtttaaacaattattttcaggaatgttttcaaactcagatagtcttccgataactgatgtagaacaagcgatacaatcatcgaatgctattttgcttgatgttcgcgaagtcgacgaatttgctagtggacatattccacaagctatcaaccagcccttaagtcaacttgaccaatttaaaggcgacaaaaccaagaactatcttgtcatctgtcaatctggcatgcgtagccaacgggcgacagaatatcttaaatctcaaggctatcaagcaatcaacgttaaaggcggtatgaatgcctggacaggaggaatagcatgaaaataattattgtaggtggtgtcgctggcggtatgtcagcagctactcgtctccgtcgtttgatggaaaatgctgaaatcatcgtttttgagaaaggaccttatgtttcctttgccaactgcggtttaccttattacatttctggagaaatagcagagcatgacagtttattgcttcaaacgccagaaagtttgaaacaacgctttaatctagatgtccgccccttccatgaagtcattagtatcgatgctgagcagcaaactgtaacagtcaaaacgcctactggtgagttgattgaaagctacgacaaactaatcttatcacccggcgccaagcctgtcattccaaatctatctggtattgaagaagcaaacaatctctttactcttcggaacgtacctgatttggacaagattatgattaaactagaccagatcaagtctggtcatgttgtggtaattggtgcaggttttatcggtctggaaatggcggaaaacttagctttaaaaggctggaaggtcatgcttgtcgaacaagctccccatgttttacctacttttgacttagaaatggcacgatatgtggaagcagagctaaccaataaaggtgtcgaggttatcactgggcagtctgttactgcttttcatgaaaaaggacaggttctagaattgtctaacggacaaaccttgtcatctgatgtgaccattctctcagtcggagttgctcccgacagtcaactagccaaagatgctggagttgagttaggtctccgtggtggtattctcgtagaccaaaactaccaaactagtcagaagaatatttatgctgttggtgatgctattgttgttaaacaagaaattacaggtcaagatgccttgatttcactggcttctcctgctaaccgtcagggaagacaggtagctgatgtcattgctggacttgatagaaaaaacaaaggatctattggaacagctatcgtaaaagtctttgacctagctctagctgccgcttcaactggtttaagcgaacgtgctgttcaatcactcggctataaacatgccgtcgttcatacaactggaaaagaccatgcaggttattatcctggtgcgactgatattgttttaaaactcattttctcaccgactgatggaaaaattttcggagcgcaagccgtcggtcaaaaaggtattgataagcggattgatgtccttgccactgctatcaaggctggactgacaatttttgatttaccagagctagaattgacttacgctccgccatttggctctgccaaagaccctgtcaatatgattggctacgctgctatgaacatcgcagaagggattagccaaaacatccagtggtatcaactagacgacgagttagctactggtaaagttctattagatgtccgcaatcctggtgaggtcgcaaatgggcaattcagagaattcattcacattcctttggaccaactccgtgagcgaattggagaactggatgcttcaaaagaatacattgtcagctgccatagtggactgcgttcttatattgccgaacgtatcttaaaagaaaatggttttatagttaaaaacctagatggagcctattcactttataagatgacattgcctaaaaatattatccaaccataagcaactaaccttctgtgattttgggtccagaaggttttttcttgacattaaatattgtatatcgtacaatctagttatcattactagataaaagagagtagataatcatgaaacagaccattccctactggcatgaattacctgatttagatttgtatttggaccaagttctgctgtatgttaatcaagtagtcaattctcaggaaagccttgaacagaagagtttatactcaatgaaaatcaacagtagcctaggaaacgaagctgatgatagaactggggttcatcaaggcaagttgataacggataatgttgattttcgaagagtattgactgctgctatgattaacaattatgtcaagcacaagcaacttgaaaaaccggtaaagaaaaaataccagaaacagcaagttgcccgcttgattgccttgactatcttaaaaaatgtcttttcgattcaagaaatcagtcagaccttaaatcttcttctccaatcgagtcattcagaaacactctacaatcattttgttgactgcatgcgaaacgaggaaaatgaagaaacccctgacatcattcgctacgcttgtcaatctgtcaaactttactacaaaacccgtcaactcactatggagttagaaaggagtcaccatgaatcctagtttgaaattgagcctgcaactatcctttggagaggaggttgctaacagtgtcacacatgcagtcggagccctgcttatgttggtcttgctccccgttactgctattcattcctatcaagattataacctgaccgctgtgattggtatgtccatctttgtcatcagcctatttctcatgttcctatcctcttccatctaccactccatgccctatgcttctactcacaaatacatcctgaggattattgaccatagcatgatttacattgccatcgctggaagctacacacctgttgccctttccttggtcggtggttggctaggttatctgattgtaggtttacaatggggattaactatttttggtattctctacaaaatatttgccaaaaaaatcaatgaaaaattcagccttttcctctatctctttatgggctggttggtggtctttatcctgccagccattctgcaaaagactggaatggcatttggcattctcatgctggctggtggattatcttatactattggagccctcttctatgccaagaaaaagccctacttccacatgatttggcatctctttatcctactggcttcggcacttcagtatatcgccattgtctactttatgttataagaaaacagcttctagtcacctagaggctgtttttaatgcattaaactgatgatcactccaatcaagtaaagggctgacacgatgctcaaaaagaccaaatgcgcctttcggctcatgactacatagcctacaaattcccgaatgaaggcattaaggctaaagtaaaatttggtttttgcgccgtagccgatacatttgattctcaattgtcgtgccaatagcagagctctgaaaacgtgatagtaattggttacaagtgcaaatcgactgccaggtttcatcagggcataggaaaatttcaaattttcttctgtgttggttgattggttttcgatgagaatgtcttcagcaggcactcctttctccaaggcataatttgccattgcctgtccttctgctatgagttcatcaggaccttgtccgcctgacatgatgagcttgctgccaggctgtttctggtagatcgctatgcctttttcaatccgcgaagccaaaagtggcgttaccttgtcaccaatcagacctgctcccaagaccactacataatcaagcttgcctgggaaaaaattgaccaaattgacaaagctagacatggtatagagcatgctgatgataatggcataggacacaaaaaaaccaacgtacacaaacaccatattgaaaaagctgatggctgatagagattgaaccacaaagggagcgatgaagagatagaaagtcaaggctaccgccagtcccatggataggaaattatggaagcgaaccccttctctcttcaaaatttgaaaaccatttagataaagtgtgaaaagcaagacaaatggaccacttaacaaggctaaaaagagcaccatagccactgctatagccagcaagcgcaagatttcattgtattcgagaatgcctgttgagataatccatgctaaagcccagacgaggatgttcaaagcaaacagtgagataaaaatcgaccgccgctcccagaaatagacaagagcaaacagaccgatagccgctaaaaataaccagaaaaagactgtcaagactagtttccccctgctaccatagacttaatgggctcaaaggtcttacggtgaatgggcgtgatgcctaacttgttcaagccttccaagtgctctgtcgttccatagccagcattcttggcgaagccgtagcctgagaactccttgtcatagtccgccatcatcttatcccgcgtcaccttggctacaatagaggccgctgcgatagataggctattggcatctcccttgatgatggaagtttgtggtatgggcgtatccaacttcatggcgtctatgagcaagtggtcaggtttctggcttaatttccccaaagcctccagcatggctaacttggttgcctcatagatgttgacctcgtcgatgagagctgcatcttttattcccacaccgactgccaccgctcgctccataacctcttggtagattgcttcatgcttggacttggggattttcttggagtcgttgaggtagcggattttgcaccctttaggcaagataaccgccgctgccaccacaggacctgctagaggtccccggccgacttcgtcgataccagcgatgaactccaccccattttcataaagggatttttcgtagaatagcatagcttctaagcgggcatcttctaccgcttctttttccagctccttacggcgtttcttgatagcagcctggacccctgctcgctcatcctgagccagttggtcccagactggactgtccagactgtctacctgggccagcagagctgtcacttccttaatcgttgccatctaagtcactcaccctgtctaatgtataagtacccaagcgaccgtcccgaacgtccttgacaaagaggttgtaaaaacggtcataatcatcacgaaagcccaatttcttggtccagtccatgatgagttcaggtgtttcctgctccaaatccatccccttaaatcgctcttgtagacgttctgggtagttggctttgaagtagtccaaaccaaaaatagtcacttcatccataggcaagagctgatccttaatggctcctgtcagagccaacttaagtccaacttcctggtcctcaaatttaggccagagtatcccaggtgtatcaaggatttcaaggtccttgttggatttgagccactgttggcccttcgtcacacctggtttgttgccaacaacggcgattttcttaccagccagacggttcatgagggtggattttccagcgtttggaataccgatgatcatggtccgcaaggtttctttttgaatacctctctcgcggaggcgttcaatcttgtctttcatcagacccttggctgcgtcggtcacctttttcaccgtcgcttgctcttttgagttgatggcaagggtacggatgccttgaccttcaaagtagctctgccattctttggtacgaacagggtctgctaagtcgaccttgttgagaatcatgagcttgggcttgtctccgacaatcttggtcaacatggggttttggctggataggggcagacgggcatcgaccaaaatggtcacgaaatcaacgtgcttgatgttctcctgcacctgcctgcgagcttttgacatgtggcccggaaaccattgaataattgccatggggtcctcctaaatatgattcattgaaaaaagccgtaaaaacggcttgtttttttattattatagcagaaaatcaatattttgtcttacttgttcctcttaaattctctcccgtaacttttcgacaaagagataggctgcgggacaaatcagagtattttttattgttaaattgttgatttgataaatcttcttgcggtcagtatgtggaaattctcgacaggctttgggacgagcatcatagatactacatagattatcgcctccaaggaagggacagggcatggattgaaataccttatctccgtcctcatccatacgcaaatacatatcctcaaaaactggaagtttcatgcgcaaatgcttggcaattcgggtaatatctgcttctgtaaagagtggtcccaatgttttacaacagttggcacactctgtacagtcgatttcagaaaatacttcggcatgaatatcttgaacaattctatccaaatttttaggtgttttcttcttcaaatttgctagaaattttcgatgttctccttgcttctgctgggccaattgcttgtatctttcaatgtcgacggtcataatctctccttttcgtccactattataccacaaacgaatggttaagctctgctaattttcaaaaccttcttcagaaaaaatcctgcaggaaacttctgctacaggtagaccaataatggtgtgaatatccccagaaatacctgctacaaagcgtggatccagctcctgaataccataggcacctgccttgtcgagtggctgcttttcacggatatatgattgaataacctcttcaagggctggataatagtcgacaaaatcaatctgtgcaaccgtataaaaaacatccagtgagtgtcttgtccgtaggcagacagatgtaacaacgtgatgactctttccaaaataggaacgtaacatggtttcagcttctgtcaaatcttgaggcttgttaaaaatttgcccatctgacactacgattgtatccgcagaaatgtagagatgaccagttaccaaatccatgtccgatttggctttggaaatttcacaacaggtttttgcagctcgagtgagaaaatcatctgtagcgaattgtttcataaaatgttcttcgataccacgctcatccacttcaactgatgcgatttgtggttgtaaaaatcccaataattgtttacgacgtggggagttgctaagcagaacgtaagaactaatctgctcacaatccccctctttttgatattgaaatacagtttgcatgtttcctccagtcaaaaacagagtccgaagaccctgttttcagatgattgattaattttcttttctacgacctactgccacggccagtcctgcaagacctaaaccaaacaggctgagcgtcagattcatctgatcaccagtatttggcaagactcctgcttttgtagtttttgctggacttgctacttctgtttttttatctcctactttcggagaatcaactggggccttcttgtccgttgctgaagtattttgtacttgattagatggtgaatccgtattttcggctggaacagtttctggatttgaggctggattttctggatcagtatccaataaaatttcgataaagtctgggtagccatcttcatccgtatcaatgcttgaatttacaggaatgatacgtgaatatgggttgacaacctcataagctgataagtcagctgtctttaggtattcagcaaagacgctgtccattgaaggaccttcttcacgtgctccgccaagcattgtgtagccatcaccaccagcagcaaggaagtcatttgttgctaaatagtacgttttttcaagatccaaggcgtcatattcgccagtctctggattaagaataccgataagaagaacacgttcttctacaggaagagttggatcgtagaatacatttgctcctgaaatgtgtaggaatccaccactagcttcaaagagcggcatgccattttcatctaaaagcatctcgccagtttctggattcacttgcaatgtagatgataaagacttggtaaacatatcataaatttgctgaccagtcacagtgatttgagaaacaatgttaccaaatggcaagactgcaataatatcaccttttgtaacaggctgatctttagcaattgttgcacgtagaccaccaccgttagtcacagcaaggctagttttgtttgaaaatcctgtttgaccataagcatagatcgcatccgtcactgcattccccaagttggtttcgcgaacacgcacgtttgagcggtctccgtttaattccactgggttattttcaataactacttgagcattttcagcttcatattttgctttaatttcatcaaccaaggctgcgattttagcatttggcgtcacatttttagtatccgcagcagaaatcaagctagcttcacccaataatttatcggatttcaaggttactttaccgatattgttcaagtaagagcctgtttgattataagtaacgttatctccataggtagtcgcttctaccgtgtgggaatgaccgtcgataacaataacacgtttaccagctaatttactatttttagaaagtgcttcagcaagagttgaacctctccattcaacaggcgttgtagaatcgacacctaggtgagctagaatgatatagttcttgtaaacacgattatctgctagagcgcgcgcttccacttcgtcaatcactttattgacttctgtgactgggtcggtaaatgttactccctcaacatttttcggatgggtttttgtagcagtttcaggtgttgttacaccgataactacaaattcatcgcctacaacagttggagttttatcgacaatagttgaagcttcaaaaacacgagcaccattaacgtaagtgttagcactcaatagcgggaagttcaaggtttccttgtacttgattgcttgatccatcccaaagtcaaattcatggttaccaacagccattgcatcatagccgacttggttcatgatattggcgcggtcttcaccttttgtagagttggaaattggaagtccttggaaggcatcaccagcatctactacaattgtattttctactttggcacgttcttcttcaatgactgccgcagccttagcgtcaccgatgacattcttttcttcaagaatgcgaccgtgaacgtcgtttgtgtggataatgactgcctctactgtttcttccgcagcagggacaacagtttcctccgttgctacgttttcaactgacgttgctggtaccgtagcagttgcatcagtcgttgctggtaccgtagcagttgcatcagtcgttgctggctgattggttgtggtagctgcagtcgttgtctcagcagcttgtacttgttgagctaaaacaaatggcgccaacaagagtgtggacattacaggcaacaagatttttttctttttcataaatagacctttcttcggcattttttatatctctattatacactttttatcaaaaaacaaaaacattaaaatcgcttacatgttaaaaaggttcgaaataagcgaattagctatctaatccgctcatttcctatttaccaaatactatttgtccatttgcaatggtgtaaaggacctgtcctttcagactatcaccaacaaacggagaatttgcagacttcgaggcaaaatccgctgtgaccaaccgatttgcatttgggtcaaaaataacaagatcggctgggccattttcagcaagatagccagcatcaagaccatagagcttggctggattaatggtcattttctccaacaattgtacgagtgtcagatgcccttcttccaccagatgcgtcaaaccaagtgaaagcgaagtttccaagcctgtcattcctgaaggagcttgcgtaaggtcctctacatttttctcatctgggtgatgaggtgcatggtccgtcgcaatgacagagataacaccagatttcaacccatcaatcacagccaagcgatcactttctaatcgtagtggcggattcattttagcattggcaccttttgttagaagtaattcttctgttcgtgaaaaatgttggggtgctacttctgccgtgacgtttgctccgagaccttgaacaaattcaaccaccttgaccgactcggctttggatagatgctggatatgaacacgcgcacccgtttcataggcaatcatgacatcgcgagcgaccatactgtattctgctacgcctgttgctccacaaacatgaaaatgtttttcagctacttgctcgttgagtcccaagacaccattcaggtcagggtcttcttcatgcagactgatgagacagccctgctctttggctaatttcatagcttttctaaccacgccagcatttgtcaaaggaataccatcgtccgaaaaggccaccgctccagcttctagcaaagcaggaaaatcggtcagattttgcccatcgaaatgatctgtaatggttgccacactataaatatggatggcttcttttttagcagaatccaatacttcttttaaggtttcaatatttgaaatcgtcggactagtgttagccatcatgacaacagaagtaaaaccacccgctgctgcagaaagagctcctgtatgaatatcttctttatgggtctgacctggctcccgaaaatgcacatgaacatcaaccaaaccaggagcaacgactaatcctgtcgcatcaatcacttcttgctcaacatcttctgaaatcgactccgcaatcttaacaatcttacttccgtccatcaagatgtcgcaaaccttgtctaaaccggattgcggatccaatactcgaccatttttcactaataacattcatattctcctttgtagtaccaaagccattaccatctactatcgcagccaatcaattcctgttctgccttgtgaagtcaagtaggcatttgcttgtgagaagggcttgcttccgaagaaacctcgataggctgaaagagggcttggatgagcagattcgataaccagatgttttggattggttatcaacgcctttttcttgcgagcataagcaccccaaagaatatagacaacaggctggtctaagctattgaccaccttaataacagcgtccgtaaaaggctcccagatttgccctgcatgtccatttgcctgacctgctggaacagttaaacaagcattgagcaaaagcacaccttgttccgcccatgctgtcaaatcatgatcttgtttgacgccaatatcatccgtcaattcttttaaaatgttttgaagagatggcggagctggtaccgagttcggaacagaaaatgacaagccctgtgcctgaccaggtccgtgatagggatcctgtcccaaaataactactttaacctcttccaaatccgttgtttgaatggcagcaaataccttctcacgaggcggataaatggttccaccagcataaacatgatctaaaaactgattaattttaccaaaataatgctctggcaactgtgcctttatcaattcgtgccaagctgaatgttccataaactgctcctagtttgaacttttctctttaacaatataaatcggacgtttcttcgtttccaagaaaacttttgccaaatatttaccgagaataccaatggtcatcaactgcagacctcccaaaaataggatgatacaaatagtcgacggccagccaattgtaggatctccgaacaccaaggttttgaaaaccacaaaaaccattagaactagcgacaataggaaggtgaaaaaacctgtataggaggcaatattcaaaggtgtatctgaaaaattgatgattccttcaatagaataagaaagcaatttccagaaagaccaactagtttcgccagcgaccctctcaacattttcatagggcaagtattctgtttcgaatcctacccaagcaaaaattccttttgaaaagcgattgtattcagacacagatagaatggcatctaccatgtgacgacgcatgagacggaaatcacgggcaccgtctactacctcgacctggctgattttattcatcaatttgtagaataattttgcaaaaaagctacgaatcggtggttcaccatcacgactgacacgacgggttccaacgcaatctaaatctggatttccatccaacatagccttcatttccatcaacatttcaggtggatcttgtaaatcaacatccatgactgtcactagctcaccttgcgcagcttgtagacctgcatagagagcagcttctttcccgaaattccttgaaaaggaaagatagcgaacagctcggtcttgaccagacaattggcgtaaaaccgttaatgtcccatcctttgaaccatcattgacaaaaatatactcaaattgttcccccatctccttacgaactttctccatagcatcgtaaaaatagggaattgcctcttcttcattaaaacaaggcacgataactgaaatcatgttcttctcctcatacggtcaattattgtattctcaaaatacgttagagactattataccattttacaggataagttcccagaaatcgtgcgtgggctcgttttaaatctagtcttcctgccaagtttcttgattttgacggaactttttaagcagattcaaaccatctgcattgatatatccctgtacttttgcgaccttgattaactctgaataattgctaagcgtcaccaatttcacgccagcattatcaaaattacgatctgcctttggcaattcataggtaaagattgccacaacaccaataacgtcagcgccttcacgctcagctgctgctacggcatctagaacagaccctccagtagaaatcaggtcttcaacgacaaccattttttgtcccttgacgatgcgaccctctaattgattccctgcaccatgatcttttggtttgctacggatataagcaaatggcaaattcatccgatctgcaatgatagcaccatgaggaatacctgctgtggcagttccggcaatcacctcaacctcagaaaattcttctttaatacgttggacaaagccatcttcaatcaaatttcgagtttcaggataagatagtgtaatacgattatctgtatagataggggatttgatacctgatgcccatgtaaatggcttttctagacgcagatgaactgccttaatatccaataagtgtgatgcgatttctgttgctagtgtcataatagacctccttctaaatgcgtaccattccaacatgaccatcccgccgaatagcctgtcactcctaaagtactggttcaatctatgaaccctacaaaaaactatatttatccctgttgaattcttacagacttctcctagtccaccatttcaatccatgaatcaaaatactggtcaataaaattggttttctcttttatttctgtcacggtaagtttttcatcaagacctgtcagaacccatttatcctcgatatcatctctgcgatgtataatcgcgaccaatttcccctcgaaagctgtcaagggctgccgaacagctttggaaatgatgtaaacatcttgctcttcaccatctccagccaatagatttggaacatagccgtaattgattggatactggttgccaaatttatcaatatacccgagaggtctatcgattataacctgataaatcttatccacgattccactcctctttaatagacaaataggtctggtaaggatgttctgattttgtaatcgggcgacctaccacaatgtaatcactaccgattcgagcagcatctgctggtgtcataactcgtttctgatcgcctacttcaccgccagtcggacgaatccctggcgtcaggcacacaaaatcagaacttgtagcatctttaatcaaagccacctcatgagctgaacaaaccaccccatcaagaccagcttcttgtgctctttgagcataatgaacaactgcttcctgcaaactagtctgtatattctggtccgtcctcatctgctcttctgaggtagaggtcaactgagtgaccgctattaaaacagcatccttacccaatccccttcgtgctgcccgcatcatctcaacaccaccagcagcgtgaacgttggtcatatccacaccgagttttgccaagactttcatagcagactcgacggtattaggaatatcatgcagtttcaaatctagaaaaatactgtgaccgcagtctttcaaataattgataatacctggtccctccgcataatacaactccattccaacctttacatagagtttctcatctggtgggaactgttccagaaaagactgaacttcttctttacctgcaaagtcaagggcaataattggtcttgtttctttcataaaatcctttcatttacacaaaaatccctgccaaatcggtcagggatgtgcacgaattcagcttgaaaatcacctttcaagcatattacatgacaccttcctagcctctctggacttagttaaaggagatattttctttatattactcttttattttacctttgtcaacgcttacccaagctatatctgatttctcggcgtaaaccttccaaactatcaataccataaacttccatgcgttttggcaagtcttgaataatctttggacaagcaaatgggtctgtaaagttggctgtccctaccccaatggctgaagctcctgcaaccatcatctctatagccttgtccgccgtatccacaccacccataccaataatcggtaaatcagtcatctgagcaacctgacgaatgagtttgagagcaaccggaaaaactgctggacctgacattcctcctgtaccatttgccaagattggttgtcgagttttgagattgaatcgcataccaaccaaggtatttatcatcgtcaagccagtcgctccagcagcctcagcagccttggccaacagggttatgtctgccacacttggtgtcagcttaacgtaaacaggtacagatgaggcttcgactgctgcttttactgcttgataggctaattctggcacctgtccaatcaagagaccattatttccgtggtccacattgggacaggaaatgttcagctcgatagcttttacgtttggagcctttgaaattttccctgacacataggcatattcctcattggaaaaaccagccacattggcaatgatgggcaaatctgggaaatgttgctctaaccatggtaatttttcggataagaccgcctcaacacccggattttgaagtccaatggcattgagcatacctgctggtgtctcggctacacggggagtcgcattgccataacgaggatgacgggtagtcgccttaatcataatagatccaagctggttaaggtcataataatctgcatattcctgaccaaaaccgaagcagccagaggctggaatgatgggatttttcaagtccaagcctggtaaggaaatcgctaatcgttttgtcatttcaacctcctacaaaattagactacctgtcgcaaagactggaccttccttgcagacacgcttgttctcgtgttcttgtccctctttgggtttgacaacacaggcatagcacgcccccatcccgcaagccatcctagcctccagtgaaatgtaggcatgaggatgttcctgaaagcgttggtcaacatagttcatcatagcaggtgctccacaggaataaatggctgcaaactcgtttgtcagctcttcaacgaccgttgcaacattccccttacgcccataggaaccatcatccgttgtgacatagaccatcccataacttgccagctcctcttccaaaatgacggcctctttggtggcaaagccaatgactgacgtgacattgacaccacggaacgcagcctgtttggctacttccaccaagggaggaacaccgattcctccgccaatgatgagaatgcggtcaccttctttgagaaagtctacttcaaactctttcccaagcggtcccataacatccaaatactgcccgaccgtcattttcgaaaagacttccgtcccttgaccttccactcggtaaataatccgacattgagacttattccgatcaatctcggaaatagatattggtctccgcaagagcatggaatcatctgggacacgaatatggataaactgccccattttcatatcttggaccatatcaccctgcaaggtcatagcaaaaattcgtggcgctagttggacttggtccaccagtaacatctgttcttttaaaatcatcttttctcctattctatataacaatgacacagaaaacaagaaagtcgatatagagaaaaaaccttgctggctagcaaggttacacgaaaagaaggcagtatttgccctatttatcacgttcccttcttcgcctctctggactcagttaaaggatatattttcagcattatacattttttagaataatttgtcaaatcatgttacaatggaggtatgagaatccaacaattatactatattatcaaaattgcagaaacaggcagtatgaatgaggctgccaaacaactcttcattacccaacccagcctttccaacgctgtacgagacctggaaaaagaaatgaaaattaaaatctttttccgtaattctaagggcattaccctgacaaaggatggcatggagtttctttcctacgctcgtcaaattgttgaacagacagagcttttagaagatcgctataaaaatcctaatgcaaaacgccaactatttagcgtctcttctcaacactatgcctttgtcgtcaacgcctttgtctcacttttgaaagaaactgaaatggaagattatgaactcttcctacgtgaaacacggacctgggaaatcattgatgacgttaagaattttcgctcagaaatcggagtgcttttcctcaaccatttcaaccgtgatgttctgctgaaactgttggatgacaatcgactatcctatacaactctcttcactgccaaaccacatgtatttgtcagcaaaaccaatcctttggcacaaagaaagtcaatcactctcgatgatttggtagatttcccctatctcagctatgagcaaggtattcacaactccttctactttgcagaagaaattctagcccaggaacaccataaaaaatcgattgtcgtatctgaccgtgccacactcttcaatctcttaatcggtctagatggctatacaatcgcaacaggtatcctcaattcaaaccttaacggagataatattgtatcaattcctctggaatttgatgatgaaatcgaattggtctatattcaacacgaaaaggcattgctgtccgacatgggagaaaaattcatcaattacctacttgaagaggtaaaattcgaccaaaaataaataccactttatatagacaaacaaaatacaatatgttatgatacatttatgaaagacgttgaaaagaaaaatgaaaataattcacttttctttaaggaaacgctttcatttttttatactctatgctataatacatgtatcatatatattaaggagtggttagatggctcaaaataaaatgttagctatgattcttgctggtggacgtggaacacgtctagaagggttgacaaaaaaagtcgccaaaccagcggtcgcatttggcggaaagtaccgcattattgactttcctctcagtaactgtgccaactcaggtattgatattgtcggagttttgactcagtatgagcctgttctcttgaactcatacgttgcacagtctcaacgttggggacttgatgtacaaggatctggcgtctttgtattaccaccgagtgaaaaaatcgaaggtttcggactttacaaaggtacagccgacgctattacacagaacattgatttcattgatcttcacgatccagagcacgtattgattttgtctggtgaccacatctataagatgaactacgacaaactccttgatacacatattcagaaaaaagcagatgccacgattgcggttatcgaagttccaatcaaagaagcttcacgttttggtatcatgaatacggacgaagattaccgtattgaagaatttgaagaaaaaccagaaaatcctaagagcaatttagcatcaatgggtatctatatcttcacttggaagaccttgaaaaagtaccttcaagaagatgacaaattggacacttcatctcacgattttgggcacgacatcattccgaaatacttagaagatggtcgcactctcattgcccatccattccgtggttattggaaagacgtaggtaccgttaacagcctctgggaatccaatatggacttgattgatcacgctggagatttggacctttctgaccgctcatggagaatctattcagaggataagggatctcctgcccaagtcattggtgcaactgcaacggttaaatctgcctatattgataaaggggcaatcatcgatggtactgtagaacattctgttatttcaacagatgtgcaagtcaaccaaaatgccgtagtaaaaaattctgtcatcctacctggtgctattatcggcgaaggtgttgaacttgactacgtcatcgtcgctgaaaatattaaaattgccgacggagttaaactcacaggagacatcgaccatatcctcttgattgacaagaatgtgaccaagtaagaaaggactgctatgctaagaaatactctcggaattgtaaatattgaaggaaacaacgtacattttggtgacgtgatgaagcaccgtggcgtacaagctttcggtttcttaggtcgttatcgcctaattgactttgctctatccaatatgtcaaactctggaattacagaattctaagtatacatgcctgccgaaatgcgttcaacaattcagcacgttggtacagggaaacactataatatcaacagcaaacgcggtacccttcgcttgctcaatagcgcaacagacccaaatagtgtctatcgtcacgatattaatgccttcacagaaaacatccactacatcgaaaattctacaaaagattatgtgctagttgctccatcttacttcatctatagccaggatttttcaaaagtcatggatgaccatatcgcaacggatgctgatattaccgttctttataaaaacgtttcagatgctaaagaaaatttcatcggttgtcaaactctcaaatttggtgaagaccgtcgtgtcgtagcttttgaggaaaaccatggtaaatataaaaaccgtcccgtttcccttgaagcctacattatgaaacggactacatttatcgacttgattaaacgtgctaacaaagtgtcgtctctctactggttaaaagatattttacgtgatacagttgaccagtacaagattatgggctatgcacatcgtgattatgtcgcatgtatcaatacgacagcttcctacttcaatactcaaattgaattgattgaccaagatacccgcaaactcctcttcaaacatgattggccaatccatactcaaacaagtgatagctcaccatgtttatatggtccattggcagaggtcaaacgtagcctaatttcaaatggagcgaatatcaatggtcaagtcgaaaattcagtcattgaccgcgatgttatcattgaagaaggtgttgttatcaaaaactcaatcattctcaatggcgtgacaatcaagagcggggcgaatattgaaaatgcaattatcgataaagcaactaaaattattcacccaattgacatcaagggaagcgaaacttcgccttcatacttgaaaccacaccaaatcatttaggagctaacatgacaaaaaaatctgttctctttgtagcatccgagggacttccattcatcaagactggcggattggctgatgttattggctctttaccaaaagaattggtaaaacagggtttagatgtccgagtcgttctaccactctacaaaaaaattgcagtaaacaatcactctgatttcgattacgtatcaagttttgatgtgcgggctggcgacatccaatctatggcaaatgtttacagtcaggttgttgatggagtaacattctattttattgaacaccgcgatttctttgaacgcgatgaactatatggatacgacgatgatgccatgcgttttggctatttccaacatgctacatgtcgtctgttagaagcacttcatttcttcccggatgtcatgcacacacatgactggcacactgctgcccttccattcctttgccgtactttctatagctaccgcgaagaattccgcaatatcaagcatgtattcactattcataacttggcttttcagggtatttttcacaaacaagcactttggtcagcgcttggcatggactatagctactatttggatggtattgcacgttttcatgatgaatgtatcagcttcatgaagctgggtatcctatacgctgacaaggttactacagtttctgaaacttatgctcgcgaaatcctaacggaagaattcggcgaaaacatgcaacatgtactagagttgcgcaaatatgacttggttggtattgtcaatggtatcgactatgacagttgggatagtcaaacagatcagtaccttgtgagaaattatagtcttgaaacgattgaaagtaaaaaggctaataaactggccctgcaatcacaatttgcccttccacaagatgagaatgtcctattgataggtatcgtctctcgtttgacatggcaaaaagggttctacctcttgaccgaggtacttggccatcttcttcaagcccatgtccaatttgttatcttaggcaatggtgaggaagacattgaaaatgcctttaatcactttaaacatgcttatcctgataaatttgcattctaccgtggttacaatgaaccacttgcccaccaaatttatgcagcaagtgatctcttccttatgccttctatgtttgaaccatgcggcattagccagttgatttcaatgcactacggaacactccctctagtgcgtgaaacaggtggcttggttgatactgtagcaccatacaatatgtctaccaaggaaggaactggctttagctttggagggcgtgacgcttacaatatgcgacaagtctatgatttagcccttcaaacctactatgaccgtcccgatgactggtatgccatggttgaacaagctatgaagcgtgattttagttggacagcttcggcagagaaatacatctggctctaccgtgaaattagtggttaggaaataagatgaaaaaatatactgaatcggagtgggaccctagtccactccttttcggcaatggagattgctatgacagaatttactgacctagatttatattatatgaatactggtgagcataccactctttacgaaaaaatgggtgctcatattataaaagaacgaaacaaaattatcggaacccaatttcgtgtctatgccccaaatgccagagaagtattcttagttggcaactttaacgagtggcaacgcagtcactctatggagcgtgaaattgatggagtatttcaactttatgtagacggattaaaatcccttgaagattataaatacctgattatcacacacgatgggcgtgaaatatataaggctgacccttatgcatttttcagccaagttcgtccagacactgcctctacaacctacaattcgcgttataaattcaaagatgacatctggatgtataatcgtgttaactatgattttaaagaacagccagtatccatctacgaggtgcacttaggttcgtggaagcaaaaatttgctaataaaaatgaaggaggagctcctgtagaagctttcaatagttataaggaaattactccacttctcatcgaacatatcaaggaaaataactacacacatattgagttattgccaattaccgagcatcctctcgatgcgtcttggggctatcaggtaacaggctactacagtccaactagtcgctatggcaagccagatgaacttaagtatttagttgaccaatgtcaccaagcaggaatcggagtgattcttgactgggtaccacttcatttctgtaaagatgctcatgggctctaccagtttgatggtagttggctatacgaatactcctacgaacaagaccgtgaaaatcaccagtgggggactgctaattttgaccttggaaaaggactgactcgttctttccttctttctaatttaaaatactggttggaatatttccattttgatggcatccgtgttgatgcactatcttatctcctctattggcgtggtgaaacagatgaagataagataaatcatgccgcaattgactttatcaaacgtgtcaatgccatggtccataccgactataagggagtcttgatgattgctgaagactcttcaagcttccctaaagtcacacatcctctagaagatggcggtattggatttgatatgaaatgggatctgggctggatgaatgatacactaaaattcgtggaacgccctgctatttatcgaaaatatcactcaaatgaaatcacttttggtatgtactataaccaaaacgagcaattcttactaccactttcgcacgacgaagttgttcatgggaaacactccattatcgagaagatgaatggcgactacgaagataagttccatctggctcgagtctactacagcttttactttgcccatcctggaaagaaattactcttcatgggaaatgaatggggtcacatccgtgaatggcacgaatatacagaaatggactggggactgctacaatttccaatccaccattctttctatcaaatgatgaaaacactatctactttctataaagaacatgatgctttctggaaatatgactaccaagcctatgaaaaaggatttaattgggtaaaaatagatgaagaagcaagcctgtatgctttttctcgcactagtgatgtgcaagaaatcttgactattcataactttaatgatcaagaactatttgatgtacacttggatttgccagctgacagcgaatataaacttgtcttctcatctaatgctattccaatggacacatttagcctctatcccgatgaaaatggagccagaattactgtaccacgtttgaccagtttttatctagagcgtgtgaaataattatctataaaaaatggagtattgaaccgacccaaattttctgtctaacttttggtgtgtggctcacttactccattcttttttgcatgcaaaaacaaccaccgtttccgatgattgttcatttctcttattcaacacttgtatatgttgcagctttctcaaggaaagtatcaaactcaccacttgcttttacttctgcgataaccttgtctatcgcagtttttagttctgtactaccttttggcaaagcaatgactttcgaattctcatcaatcgttggaaattcaacggatgcaacggctaaatctgaattctgtgaaacataaccagcagcaactggagaatccattaaaatagcatcaacttttcctgatttgagctcatttacagcttcacccatcaaggttaaagaaattaggttagcttgactaatgttttcctgtgcataggattcttgtgttgaacccttttgtaccgcgagagttttcccgctcatagcatcaattgaagtgagtgaattggcgctatcttttttgataagtaatacatcagaaatttgatagtaactttcagagaaatcaaaaacttttgcacgctcttccgaataagatagaccagcaattgcaatatcagctttgccattctgaacgctagacaatacattgtcaaaactcattgctgaaacttcaagcttgaccccaagttcgtcggctattttttgagccaacataatatctgcaccaacaacttcattctttccatcaactagtgcctgaaactcgaatggagcatagtctggactagttgccactactaatgttcctttttctttaattttatctaatgcggattgtgatgacgtcgaagaacaagctgccaatgtcagtccagctaaaactgttgctgctaatgccaagatttttttcatatttcttaaataccttctctttattttaataaaatacttattctaaaaaacagaagcttattgattttcattgtattttcttgcagtttttcagaatgtattctcattttaattcatttttatacatttgtcaagaaaatattatttttattcactttaattgtataaaatttaattattagcaatggataattcataggcttcttgaacaaattgatccatctgtccagattccactagttttgtaatgacagagtcaactttttcctttaaagctgtacttccttttggcaaggcaatagcataggcatctgaatagctactttttatctcagtatctaaaataaccaagtcatcatttttggcaacataagctttcgcaatcggctcttcaaaaataactgcttctaccttctgtgattttaattgattaattagctcgccgttcgaagctagagcaataaccgtggaggacggaagctgttctttaataatttgttcttgaatagaacctttttgtgctcctatatttgcctcagctagagaatcaagcgatgtatattgtgcaagatcctctttatttataataactttattggttgaggtgtagtaaggaatggaaaaatcatacacttttgcacgctcttcagtggctgaaattcctgaaatggcaatatccgattgccctgactggacattgttcaaaacattatcaaaactcatcgctgaaaattcgacttctacacccaattcttgaccaatggcttttgcaagctcaatgtcagctccaacgattgtatcttttccatcaaccagtgttctaaactcaaatggtggaaattctggattcaatgcaacaattagttttcccttttcctgaacatccttcaaggaagtatcttcttgagtagcatttccactgcaagcacttagggtcatcgttgccaacaaaaccaatcccatcataatatattttttcatcatcatattctcctttaaaataatcctgtgcatacttataccgttttttatataaaacatcggacttccattgtagtaaaatgcatattttttctccttttttgaaagataaaaacattttatgtcatttttatacatttgtcaactcatttgttgtatttttattcaaacaacataaaaaagaagctattcctagcttctacctaaaattcttgtcccactctccatcgtcattttttctagtataaaagaactcggacaaatctggctcatccatgactttcaggatttctagtaagtcataggccaaatccatctgaggcagttccgacttctcaacccaacgcacctcgccttcttcagttgatcggatagttcctgtaaactctgttgccttatagagaaatacaatgtaacgatgcccttccttatccggccaatgtttaagaccaaccaagcgagcatcagtgactgttaaacctgtttcttcttgcacttctctaacaaccgaatcatggaaattctcgccttcttcaatatgtccacctggaaaggcaacaccagaccaacgataacgcttgggatctcgaatctgtacaacgaccttcccttccttatcttcgattagacacatgttagtcaaagtgaccatttcttttctagccattttctctctctttctgtttaaaaatcattctatattctgtacgttctgcacctaaattgaccgtttttttgacaccatcaaatcggaagcccactttttcatagaaggcaatggcacgcgcattcccctccaatacccagagaataacggtttcgtagctctgcaatttttctaaagctgcctgcatgagctggtagcctatcttctgattataatagtccgccaagacatagagggcgtagagctcccctaccccttgcaaatcctcctgactagatgagccgtaacaggcaaagccaacgaccttatcatccatcacagctatcaagatattctgaggataccgaactgcccagtcttgacagcgttctaaagtgtaagtattctttaaaaattcctgaggtaacaagtcagcataggcctcctgccatgatttccaatgaacataggccttgcctagcatttcacttttcgtttccagtggtttaatcatcatctaaaggacctccgaattttttcctctagtatacattaaaaaacaagttggcacaagaccaacttgttaatgattatttaattaaaaatcgatgttctgaagtcatttgtagagttcatcaaggcttgataaactttcactttgagtgcatgaacacgactgttgttcaagttgaggctgttcgcttggatgtctgcttccatggcctctttcatcaagttttgcaactgctcaaagcttgtgatagttacttccttggttgaatcagcaacaccaagttcatactgcatggtaaacggcttgagttggcctgtcgctgctttttccaaacgctcagtaaacatggctttcttaaactcagcccatgaagtatattgaccttggaagacatattctaagacatggtcatccgtaatcaaaccagtattcttcttgttccaagtatcatagatgattgagcctttctccatagctagatcagacaactggccagaagcatacggtacaaaaccatctgtgtaccctttggcagcaattaattcaaaggccatacggcggaacatgatgtcgcctggagaaccgtttgagtttgaaagggctgagaagttagctgcaaacattggaacgctgacataactgtttctatcccacttcttgcttgtgttagttggattgttgacatattggcgttgaacaataatgctctgatcaatcaaatcattgaaggacttcaagcttgccacttcggcatctgtcaatgcacgcgcagaatttccagcatgggtatcaacaccattattttggacatagtagttttcaatcttacgcaaccaagctttcttgttagcatctgattgagccaagatgtttgtaccttctaggtaatccagcaagtaaagtacatcaaattggttatggtaatactcattgaaatcagcttcgctattgaaacgtgcaactgggtctccgacatggacacggttggcatcatcgctattatagacagcgttgaatccaaggttcatctcagtaacattgaagacattttgtagaagaccttgggcgtaaacttccataccttgaccaatacggcggccatagcctttcagataaatatcaccatcttggttgtgaaccatttcgtgggtataaagagctgtaccgtaatccgtcaacatatcgtaagtaatatagtaggtctcacttccatccgcaaaggcagtcttaatagacggatgctcacgataccacttattgatcggaccgtagaaatcttggatagcatcaacatcagctgtcaagttgcgataagacttcgtaccatctttaccatacatcacataaccttcgttattgaggacagatctgaatagcttgtcacggttggtttcatccaaaatcttataccagaagtctgcattatcacgctgacgttctgccgccaaatcaaccatctgacgaaccttatcacgattttcaactgttgaataatcatctacatagtgctcatatgaaccaatcgcgatggtattcatgtttgtgatgataaagatattttcttgtggcaaagtcaagagtggcaagagcatgtggttgtacttccaagttggattggatacagtatcattcacaatcttgctataagctccaacattgtacttgctatatgtatctgtcgtttcctgcttagcagctacttctggaatcaaggatttaccttcaacaacataagccttggttgtttgcttgaaccattcattgttggtcatttctggcaagaagagctgacgataatcttccagcatatcgaaaagcttggtctgattattttgtttaccaatgatggatgcaaaagtggtcacgttattgtgggcacgaagaacatcatagccaccattaccaattgcaagaatcatatctagggcagatgctgcatcatttccgaagaagtcaggttcaaagatggtcaagtctttggtattcatctctccgaagttgatgtcataccaacggttcaagtaagtcaaaccgagcacaaaggctgctttgttgttgatgattttctctttgatgtagtcttcagaagcctgaccttgaccatttagactagccactaaaatcttacgaacattgctttctaggttggtcatcacttggtcatagctttcaccaaagtagaaatcttttgctgtaccagtctgagtatcggcattcaaggtcgttggataattgataacagccttcatggcatccgagtcgaggacaacagaagaaaggctgcttaccaagtcattgacaagggcacttctgtcattcaagaatgattctggcgtgtaaatcaagtccgtacctgaaatggtatactcgaccacatgattattcttgaagtcttctagataagaaactgtcttgtagtccacagtgccatcagcatagtgaagcataatcttattgatattagccttctcagcgtagacgtcagcaactacagcattgtccttcattggtacaacatccagcaaacggaccttgttgagcttatcgtctgtcgcaatcttgtttccataatagacaagaagttccttgttgtagaatggcaagattttctccatgttgtagtaggcagtttcatggtcagcctgtgccttatccaaggtcaagtagtctactgaataatgattgggattaagcggtacagaatcatcaattgtcgcttgaatagccatagcttctacttttgcttgtgcttcttcatcagtgataacagtgacgttggtcaagctatcagatgttgtagtgaaaccgtctttaatcttaccagttggatttgcgggttgaccgataatgcttttcgtaccagtcatatcgctgacaacgttgttgacattaccgctatgtggagcataggcacctgttacttggttggcaccagcaattccgccgacaatggctgccgattcagtcgtcacaatggaaccagctgcataagaattatagacacttcctggtacatcgtagacaagcattgtacgaccgacgataccaccagctacttgattctctgtacctgggagggttatggtcgcatcaaccttggcatttccgacacttgccatcgtaccgttacccaagataccaccagttagacttgcattggttccggttacttcgatactacccttgaaggatacacctttaatagtagtatttgttgcagaatgaactaaaccagatacgttttgcggtcctttgatagatgcttctactgctacgtttgtaatagttgctccattggcattaatcgcaattgtcgcaagtgggttcttagagcttgtattcaggcttgcatttttgatgtccaagttttgaactttaccaccaaggttaaagaacaatggtgctttcaagttgctgatagaaaaggcgtagccgtcatttaagccatccaaggtaccgctaaagttggtcacatacgatgcaacatctccaacaggaacttcacttgcgtccaaatgcgctcctagtttaaaggtaccacttggatttgccttcatagcgtcgagcaaagctttgaaggatgtgtaggtatttgcatcagtcgccatcttaggaatgtagaattcacgattggcaacgtattgggcatccttatcctgtaccaattcatcaaaggatgaaactagtttgaagactgccttgccattcaaggtagtttcttcaatacttgacacaggtaggtatacctccttgaagcgatctgaagtcaccttgataaacaattcatctgtggatgctggcagttcttccaagaattcttgaccgatgtagctaccattcttacgacggtaaacagtcaccgcatcaatatccttgatttcaatcttcttgtagaccaaatcaaatttgcgcatgctttcaagaatagcttcttgttccgaactttgttcctgctctgccattgtgtagaaaatcttagtcttaacagtgtaatctgtgtagaaatcaagattttcaagtgtcaactggccatttggatctgtaatggtctgttcttgaaccaaggcacctgtattatcatagaggagagcaacagctcgttggaaattagcggtttcgtctgtcaacttgtagctgattgtcgctgacttggcatcgtcattttccaccaaatctgtgataatcacttgtggtactttttcaacctttgtaccacgcgcaatgacttgcttaacaggttgtttggtaatttcttctgttacagtagaattttcctgacgaacacccttgatagtctggtaagttgttgtaactgtcttagagccatttacacccgccgttacaactttggtcttaccttctagcagtgttggatcatcaacatactctgtttcaaaggtaatctcaacttgattagtttcgatttccgtaccttctattggttttgttcctttgagaacctctttcgttgttggctcttcaaggactttctcagtcactgttgggtttggttgactgactccgttgattgtctgataagtagtggtaacttccttagaaccaaccttaccttcagtaatgaatttttcttccccaacataaagttcttctgtttctgtgactgtcgtttcaaacggaagctcttctgttgttacaatggtttcagatccaataacatctgttgtcttcgtgcctactcttacaacttctgttactggttcttttgtcactacatctgaaacttgttcggatttaatcagtacaccatcggcataataattcctagtctcgattgtccgaacaccatcttgtcccttctgttcaacttcacgactaccttctgccaagtttacatcatagatttcttgcacatcaaaggcaaagacttcggtatgagtaactgtttcttctgttaaagaattcgtcgagttttcataacttggttctgtatctggtacttctgtaacaatatcatcggttgcttgttttgtaccaacttcaacaatctttggaacagcagtttttgtaaccgtcgaggaaatctcttcttccgaaataatttgaccttttgaatggacttgtttaatcgttacaatacgctccccatcctgtccttcttgtaccactcgctctgtccccgcagataattgaggattttctacggtttgaatttcgaatggaatggcctctgtcttgttgacaatagtttctgtacggattccttctgaagctgggaattccgctgttttttcctcttccgaagtagtttgttcaatagctttgctatccttcaaatatcctacataaacgtagccatcaatctcagctggggccggtaacgcttgtccggcagatatttcgattgcatggttatatcgagccaaaatttgactcgtcaatgcggagctagttggaccgaagaagcttgctcccgtagctgtcaaaaggatgacacccgccaactccttcttaccttttttaccaaatctaacagccaataacaggagagacactccacccgccaccaatagttcggtttctacagagccagtatttggcaaaacttgagacgtgcttgtcgatggagtagatgttgtgccagtagctggacgatagatcaggtaataatttacatccgtttcctgagctaagccaggcaagtcacgaataatcaactccttttctccatctgtcaattcttgctctgtcacataggaataattgattgattgagcactagcagtcggtgctgttgccacagaggacacaaaaaatagacttgtcactgccgctgagacaagtcccactgacatttttctaaaaccaaagcgttgtcgcttttcacctaaagatcttttcatataagttgttactccctaaaatagtatagaaactattatacctattcaatgatgctcctacaagttttttgtcttattcaatgaactattttcaattcaaatctgatacaaactaagcaatgttcataaaaaacgacaggatgcagtaccctgtcgctttattctttcgaatctacatattcttcaactcgataaccatatcacgaatctgggctgccagttcaaagtcaagcacttctgccgcttcctgcatctgaccttccagtttcttacttatggtctaactcaattcttcgtagcttttcaaaagaggttatcgatacggaatacttgaagtttcaacgataatgtcaggctgaatgtaatggatataaggagctatatagtctacattttcaacttttggccccaacataatctttgaatattttaatgggacaacattgatgtacgcatataaattacatttcccttgttctgttttttctatgtgaatatattttctgctgttcagataattcacattcttattttctaacaatcctatgccaatatctagtttcctacgtgtagcttcatcttttattccagagttcaatttatcagtgaatttatcagtgaatttgttagtgaaatgcgtatcatctaagtttaccaatatacgatattcagattcatattgataatcagaaaccttaaaaagataggatatcttagcaatataatcaatgatttctcgaatttcatcggttgctccctcatcttctaaatacttaattgtatcttgaatatatattagtttttgatcaactagtttatcaccagtaatattttgcttttcatctgtagtaatataatgaactttagcaaattcaataacatcatgcttgacaatagtttccaagtaatcttgatcatattccagaaatgctcccctagactcctcagcatattctttccacataggtaaactatctttaacaactgtcaaggatgaaagaaacacattggttggtttataatactgttccatatgggcatctaaaccaaggatggcgagtaaggcttttccttccatcggatcattcaattgattagcatttgacaaacgtaaataggttggacaatttttattttcttccgtctctggtttaaataagaaattaaccaaggtgtctattgtagtatagtggccataaaattcattctcttttaatttctttgcatcaattatcaatgcagaacgaatttcatcaatagctccctttattttctcaacgatttcctcgcttgaatgaggttcgctaacaggcaagatagttaaatctagtaactctattatctgacttttcataatgtcagaatccgtatacttattcaagtcttgtagaactttctgagattctgcaattgcatctgcccccaattcctttagatagtcaaggtactgttgaataaacttctcattatcctgtatatttatttctacatattgattaattatacgtaagtcttctctcttcaatatttgaatatgtttattgctggatagcaaataaaataaggccatttggtctaaatacttatcacattgaagtaattcctgaatataggaatctatctgtaatttaaacttttctttatccgtatcagaaataaacaaaaaggtaaatacgaaatatatcagtattagtaaattgagtctggttacagtatgactcacactttctctactttccaatagcgtcccaaaaatacttcccctatcaacaaaatctctaatttgatcataagtgctaactcgaacaattaattccctaaataatctagaataagcactaatgttagaggtatctctataaaagatttccgcccacacctcttctgtttttattttttcatggagcaaagtcaagagtttctttaagtgctgcgaatccaaggatgatcctggaaacacctcaagaaaagcatcgacaattttaaaaaaacgttctatatactctttggatagagagtctgctttctcacactcttcaataaactgtaacaactctttttctagctctgtattttccaattgtctaatacaggttaccacttgattagttgttttcgacgtatcaaaatatttcataactacctccatatctacatattcttcaactcaatgaccatatcgcgaatctgggctgccagttcaaagtcaagcacttctgcggcttcctgcatctgaccttccagtttcttgatcatggccttgcgttcatctttattaagagcattgaagtccacaacctcttccttgtcctgagtgacagccttggtcacgctaatcaggtcacggatctctttcttaatggtctgtggaataatgccatgctcttcattataagccatctggatttgacggcggcgggctgtttcttccatggccttccgcatggactcggtgaccttgtccgcatacataatcacatgaccttcagagttacgagccgctcgaccgattgtctggatgagcccccgttcattacggaggaagccctccttgtctgcgtctaagatagcgactagactaacttctggcacgtcaatcccttcacgaagcaggttaatccctatcaaaacatcaaagacacccaagcgaagatcacggataatctccgtacgctccaaggtcttgatgtccgagtgcatatacttgaccttgacgcccatttctttcaggtagtcggtcaagtcctctgccattttcttggtcagggtagtgataaaggttcgctcgcctttttcaacacgggcattgatttcacctaggaggtcgtccatttggcccatagttggacggacttccacttctggatccaaaagcccggtcggccggataatctgctcgacaacggtctctgtctgctccatttcatagtcacccggcgtcgcagatacatagacaatctggtggacatgactctcaaattcttccctgcgcagcggacgattatccaatgcactcggtagacggaaaccatagttaaccagcatctccttgcgtgagcggtcaccattgtacatccccttaatctgccccatggtcatgtggctctcgtcaatcataatcagatagtcctcagggaaaaagtccagcagggtataaggaggctccccctcacttcgcccgtccatgtgtcgtgaatagttctcaactccgttggtatagcccatctcccgaagcatctcgatatcgtagtcggttcgttgtttcaatcgctgagcttctaagagttttccttctgcctcaaagaccttgagttgctcttctagttccgcctgaatcttggcaatggccgtttccatgtggtcatcgttggtcacgaagtgggtggcagggaaaatggccaagtggtccacatcgcccaaaaccttgcctgtcaggctttcaatctcacgaatgcggtcgatttcatccccgaaaaactccacacgaaaggcatgttcgtcacgggaagctgggaaaatctccaccacatcgccacgcacacggaaccgtccccgttggaagtcgatgtcgttccgctcaaactggatatccaccaaggcattgagcaactgatcacgggaaatctcctgacctggtcgcaggctgaccacgctatctgaatattccttgggtgaacccaaaccgtagatacaagaaacagaagctaccacaatgacatcattgcgttctagcagagctgaggtcgcagagtgacggagtttgtcaatctcatcattgaccgaactatccttttcgatataggtatcgctagacggtacataagcttctggctggtagtaatcatagtaagacacgaagtattcgaccgcattttctggaaagaattccttgaactcactataaagctgaccagccaaggtcttgttgtgggcgatgaccaaggttggcttattgacacgggcgataacctggctcatggtataggtcttaccagtaccagtcgcccccatgagaatctgggctttttcgcccccctcgatgttatcaaccaaggtttcaatggcttggggctggtcaccagacggtgcatattttgacacaagtttaaattggttttcagtatttcgattgatcatactcctattttatcataagttcgactaatggagaaacattctaaaccattcacaactatgtccaaaatattaaattttctcacattttaatgactttgtatgtcagaaattctgacattataaaaacctcaattttgcattaattttcagaatatgatatactaggacagttattttataatagaaggagtatggaaatgaagaaaaaattactcatgttattggcaagcattctgccagtattctttatttttactggcattaaagctgacgatactattgatgtcgtatttgacaatgcttacgccccattcgagtttaaagactcagatcaaatttataaaggattagatgttgacatcatcaacgaagtagccaagcgctcaggttggaccatgaatcaaagcttcccaggatttgatgcagctgtcaacgctgtacaggctggatctgcggacgccctaatggcaggtacaactatcaccgaagcgcgtaagaaagtatttactttctcagacccttacttcgacaccaaaatcgttatcgctaccacaaaggcaaataccatctcttcatataaggaccttaaaggcaagactgtcggtgtcaaaaacggtactgcagcccaaaacttcctagaagaaaacaaagacaagtacggatacaacgtaaaaacttttgatactggcgatttgatgtataatagcctttctgctggtgctgttgatgctgtaatggacgacgaagcagttattcaatacgctatccaacaaggtcaagacctaagtattgacatcgaaggcgaagccatcggttcatttggtttctctgtaaaaaaaggtagccaatatgaatatcttgttgaagactttaacaaggctttagctgagatgaagaaagatggcacctacgaaataatcatgaacaaatggttgggagcttctaccacttctaccgaaagtacagattactcatctcgtttaagcttaacaggaaacgcatcagctaaagcaacacctgtcaaatcaagctacacaattgtggcagattcttcttttgctccatttgaataccaagatgaatcaggtaactatgtcgggattgacatggaattaatcaaggcaatcgctgaacaccaaggatttaccattactattcaaaaccctggtttcgacgctgcactaaatgctgttcaagctggacaagctgatgcagttattgccggtatgtctatcacagatgctcgtaaggaaatctttgacttctcaaacgcctactatacttcaaacatcctattagctgttaaaaatggtagtgacatcgcttcttacgaggacttaaaagggaaaactgttggggctaaaaatggtactgcttcatatagtttcttagaagaaaacaagtcaaaatatggttacaccctaaaagccttcgacgaagcttcaagtatgtatgacagtttaaactctggttctattgatgctcttatggatgacgaagcggttcttctatatgccatccaacaaggtcgcaactttgcaacaccaattcctggcgaaaaatcaggtgagtacggatttgccgttaaaaaaggtgccaacccagaattaattgaaatgtttaacaacggcttagctgccctagttgaatcaggcaagtatgatgaaatccttaataagtatttcaactcaactgaagaagcaagcacaacaacttcaactgttgatgagacaacgattgttggtcttttgaaaaacaactacggtcaattactctcaggtcttggtatcacaattggacttgcccttctatcatttgctattgcaattgtgatcggtattatcttcggtatgtttgctgtcagcccagttaaagcactccgtgttacttcatctgtttttgtagatgttgttcgtggtattccgctcatgattgtcgctgcattcatcttctggggtattccaaacttaatcgagtcgatgactggtcaacaatctccaatcaatgactttgtcgctggtacgatcgccctatccctcaactctggtgcctatattgccgagattgttcgtggcggtattcaggcagttccagctggtcagatggaagcatctcgcagtttaggtatttcctacggaacaaccatgcgtaagattatcctacctcaagctggtaaaattatgttgcctaactttatcaaccagtttgttattactctgaaagataccactatcatttctgcgattggtttggtcgaactcttccaagcgggtaaaatcattattgcacgtaactaccaatccttccgtatgtatgcaattcttgccatcatttacttggtagttatcacactcttgactcgcttagcacgcaaactcgaaaaaggaggcaaataatggctcaattaaaaatcaatgtccatgacttacacaagtcttatggtaaaaacgaggtcctcaaaggtattactgctaagttctatgaaggcgatgttgtttgtatcatcggtccttctggttcaggtaaatcgaccttccttcgtacaatgaacttacttgaaaccattacaagtggtcaagtaacagtcgatggatatgacttaaccgaccctaagacagatgttgacgccttccgttcaaatgtcggaatggtattccaacacttcaacctcttccctcatatgtctgtacttgacaatatcacatttgcgccaatcgaacacaaattgatggacaagtctgaagctgaaaaggtcggcatggaattattggaaaaagttggattggcagacaaacgcgacgctatgccagacagcctttcaggtggtcagaagcaacgtgttgctatcgctcgtgccctcgctatgaacccagacatcatgctcttcgacgaaccaacttctgcccttgaccctgaaatggttggcgatgtactcaacgttatgaaagacttggctgagcaaggtatgaccatgttaatcgtcacacacgagatgggctttgcccgcaaggttgctaatcgcgttatcttcactgatggcggtgagttccttgaagatggtacaccagagcaaatctttgataacccacaacatccacgtttacaagacttccttgataaggtcttgaacgtctaagctaaacgaaaagccttgacttgcatcaaggtttcagattgaagaaaaagtccattttggacgattttcttcaatcttttttctttatgttgaaaataaaaaactcttagaaacgccgaaatatcaatgtttctaagagtttaatgacttgctatctttcgcaaacttcttcaattttttatatttttaagagtttatctacgttctgaagctttgactttcgtcaagttttttttggtatctcaaaattaatttacaatatcatcttgtaggaccaacctttctttgtcttttcaacagcttcaaagccacatttctcaaacagtttacgggggcctgtattccagtcatatatttcttctacaggtatttcctcaagccccacttctcttgcacgttcaatcattcgctgtaataccttggttccaattccctttttccaataccgcttatctccaatggcaatggcaaaatcatctgcaaacagcgtcacatcaccaattgggataaactgattgtcttcaaaaatttcaataaagtaacattcgccatttttagacaaataatcatacatacgattgagcaagtcaagactataacgttcttgatcaccatcaatcagccagaccaattctagatcttggtgccattcaaaagaaaaatcatgctgaccatcataccgacgtaaacggacttgtttgtctatttctaaaatatctgcttgctcaattccagtgattgccatttcggatcctctctcatttacaataagttcattttaacatatatctctatcgaaatctatgaatattatagcacgctgattgacaagattctatcgatatgctatattaaaacaaataaagcatgcgaggtaaggagaaatggacaataacaagtaaactcaatttaagttctatacttatttagtagttttcttgcgtccatttttctgtttctctgttccatgaatagggtctttttgagcagatttcgacacactactaaataggtagtgtgttttttcttgtaaaggaggccttatgctactaaccactcatcacctatctctcgaccatcaaaaagatttgcgaaatctagttcaggacctaaacctcattgttaaccctggcgataaaatagctatcatcggcgaagaaggaaacggaaaatccagtctattactcaccttgatggattccactcttgtcgccgactacctgcttcaatcaggcagtattcaccgatattttcactcaccagtctatattccccaaagtcttccactggaaatagcagagctaaccctgaacgactacttcttcgctgacttggacagcgacattgattacagcctactctacctctatgctgaccagctccagtttgacagtgagcgatttgccagtcaacaattgattgaaagcctgtcaggtggtgaaaaactaaaaattcagttaatcaaatctctagcaactccatctgatattatttttctggatgagccgtccaatgacttggatttagataccttactttggcttgaaaactataccattactagtcctaaaaccatcctatttgtttctcacgatgaagactttcttagcagaacagctacaaaaatcattcatctagaatcggttaaaaagaaaacacttgcacagaccaaggttgaagaactagattaccaggattacgcattgagacgccagcaagcttatcagaagcaggtccagcaagctcggaacgaccaaaaagaatttgacaaagccatgaataagcacctacgtcaaaaatcacaggttcgtcacaccttgctcaacacccatgatgccacactaggacggctcattgctaagaaaatgaaaaatgttctctcacgtgaaaaacgctatgaaagaatgaaggaaaatcttacacaagttccttttcatgaagatgccatttccctcttcttctcagacatttcaccactaccagctagaaaacaagtgcttcacttagaaaacttccaattgaacgttgaagaacgacaattagttagcaatatccatttcaacataaatggacaagagaaaattggcatcattggacaaaatggaattggtaaatccagttttctaaagctaatctatcagaaactcaggcaccgagcagatataaacttgggatacatgccccagcgctattcagaagtccttgatgagtctaaaactccacttgattttttattagaaaatggcaatcgtgagcaggagcaacttatcttaacacatctagccagtctgcagtttacacgacaagaagttcatcacaagatctgtgaactttcggggggacaaaaagccaagttactcttgttaaaaatggttcttgatcaagccaattttctcttgttagatgaacccagtcgaaacttctctcccacttctcagccatatattcgtcaactatttgccgattatccaggtggtttggtatgcgtatcacacgacagacgctttttgaaagaagtttgtcaaagaatctatcgactaactgagaatggactggaagaactaggacagatataaaaaaggaaaatggcacacacgccaaatttccttttattatttattcataaagaatgaagccaagctattcgattcacaacctataatttatcaagagcaagttgcaaatcttcaatcaaatcattgatattttcaagaccaacagataggcggatttgatttggtgtgaccccagcagcaagtaaatcttccggagctaactgagcatgcgtggttgtagctggatgaactactagtgatttcgcatcggcaacgtttgctaaattagaaaagatttccaagccatcaataacctttcgggcttcttctgctccgccttttacttggaaagagaaaatagatccaacacctttaggcaggtatttatctgccaaagccttataaggactatctggaagtgatggataattgaccgactcaacattagggtgattgagcaagaaatcaacaatcttttcagcatttgacacatgacgctctacacggagagacaaggtttctaacccatgcaaaagcaagaaggcgttgaatggagaaagggctgcacctgtatcgcgaagtaattgtacacgaactgcaacaataaatgcagctacaccaatatcacgagtataactaatgttatgatagcttggatcttcttcaacaaattgcggaaacttaccagatgccgcccaatcaaacttaccgctatcgacaatcacaccgccaatggtcgtaccatgcccaccgataaacttggttgctgaatggacggcaatatcaacaccatgagaaaatacattaatcaaatatggggttgcgaaggtattatctgaaacaagtgggatgtggtaggtgtgtgcaatttctgccaatttttcaagatcaggaatattgataacaggatttcccaaggtttcaataaataccagttttgtattatctttaatcgcagcttctaccgcttcaaaatcatcaatatctacaaagcttgttgtaataccatagcgaggaagggtttctttgaataggttaaaagtcccaccatagagtgtcgttgccgccacaatgtgatcaccagcatgcgctaatgctagaatagtgtatgtgatggctgccattcctgaagaagtggccaaggcaccaataccaccttctaaagctgccacacgattttcaaaagtagagaccgtcggattagtgatacgagtatagatattccctgatttacgcaatgcaaataaatcttctgcttcttgagcatcttcaaaaacataggaagtggtttgatagatgggtactgcacgtgattttgaagcagaatcaacttcttgtccagcatggagttgaagggtttcaaatgaaaattctctagtcataaaggtactcctttggtctttttctgtattctacctcatttttaccatcttgactaatacttaaatattagagatatatatagttaacaactatagccataggatcagttattttagaaaaaataatattcattttccttgaataaaataaggacacgatttacaataagattatgaataccttaatagaatatatcggtccgattatcctcatagtactaataatctcttatagcatctatcgcagatgccatcctaataatatggacactaaacaagcgctcaaatgtccaaaatgtaagtcaataaaactgcaaacttacattccaacacaaaaaagatattctcgtaaagccggtatgattggtcatgcaatcaatggcatagagggagctatgtttgcaatgctctatgaagctgatcggacttattatcgttgtcaacattgcggttaccgattttctagaaaggagaatcgttttatttccaacatcgaataacctccctgatttttagagaattttgctattgaaaacgaagaattctcaccccttacaaatcccgttatatcaacatttacgaaaatgaaacttccatgaaaatggactaaaatcctctgatttggataaaatcgacaccaattaacaccataaaatagactagtcatcagtaggtcaaactaatttgacctactttatcttatagatggataatttattaatcaaattcaaaatgataggtcaagtattttataaatttatcgatataagaagacaaaaaaaactaatcaatacgagttattcttcaagaaaaaatcttttcaaaattatttctcttttaggaagttcgacttgttgctgattatctctatataaaagcattatataactcgatacaagccgtatatatggacttaatttctatagcctcaaaataatagtatagaataccaatgtctaatctttctgttgaaaagaccatctctttatctaagtgagccaagagtttgtcgcgaagcaatttgatttcatcaatatttttttgttctttatcaataccctcttgaatggtactcaaaattgataaaagagatctatctttggtactatgtctcaacttagatagaatcttaaaaataccatttttttctctgacatcaaaaattttagttataccgaagacaactctataaaataaagattcatatgttacatttcgtactatatcatatctaatagatgattgcactactctatcatgccactcatcgtttacaatttttactatttcaagtgcagcaattattgatccaagttcaagtatcatagtatgaaaatgaatcattattttagagtcatcatctggtaattcatcagcgaaattttttcctacaaaatcttttaaatcacaatcattcataagctaacacctatttaataaatcttcttacttttactcaaactgataattcattctgcttcaaaaatattttcgagattacaagcatatgtaatgtcctctctcactaagtatatcataccccataggaatacatctactacgatttttgtatcgctttatcatctcgtaattaagtcattgataaagttttctcaaaatacagctgaacaccctgcaacacttaatttaatttttcataatattaaattaagcaataaaccccactgacttattcagccagtggggtttttgagtgttttccgtagaatatttaaattacttaactatggtatttactcaataataatatcaaaatattttgtatcaacctcttttggagcgacgtaactaatatttcgtttggcattgaatatgtcagattcttccagtgatgtagagagtccgctccatggttctaatgcgataaagggactctgatttgtagttgaccaaatcactaaatatggaaaatcatcaaatgcaatcgaaagtttcttctgatgattttttgatttcaaggttacctttcgtgatgctaattgatccaatgttatggcatcatactcaaacagtttataggacaagtccaaggtcttctgattttccaagaatggccggcgatctcgcagatcaagtaagccagtttctggaaaacttctaggtactgtacaagattctactttttcaaattctaaataatagtcttcataactctcaccatccaacaagggacaattaaaacctgggtgacccccaataaagtaaggtagctttctatgtccctcaaggtttttcacccgatattcaattcgaattgttttgccaaatagtgagtagttaatagaaagttcaaattcaaaagggtaattttttacggtttcttcgtttgatgaaatagaaaattctaaagagttttcagtactttttacatttttgaacagcatttttctcacaagtccatgccttggaattgtgcctgtaaatgtcggtctttctgcaggttcatagatagcccaatcatttcgtaaacttccacaaatcggaaatagaactggtgcttgaccgctccaataggtcggttctccttgccaaagatattcgataccatccttgtctttaatagaaataatttgcccacctaattcagaaaattgtactgttaagttctcattttttaattcgagcatataaactgcctcccttatatgaaaacaaggatgctaacttgagctaggcatccttgtattagttttattcaataacctgtgtttccgctacttttttataccaataagcacttttctttggataacgttcttgggtctcaaagtcaacatagaacaatccatatcgtttctcgtatccatttgaccaagaaaatacatccatcaaggaccagatgaaataacctttaacattggcaccatctgagatagcatctgaaatcacttctaaatgctttttcacataatcaattcgaccatcgtcgtagactgtaccatctacaaattcatctttatagcctagaccattttcagtgatgtagattttcttatagtttggatagtcattttttacacgcatgatttgatcataaagaccttgtgggtagataatccaatcccaatccgttttcggaatatcgactggagattctctacgaccaactcccttgatttgatacttagaacttcccttttcacctttaccattatggataatttccgtttctccatcatgagctctcatccaatcactcatatagtaattgatgcccaagaagtcgttcaaatcttttgcggcatctaaggcagcgaagtcttcatcacgaaggtctaattccccaccatttactttcagaatatgtcgaacgccttcaagcgttttttcagaatagtaacccaagtatgtagcatcgaggataaatttattatgaataatatcttctagttccgctgcacgaacatcgtcaggattggttggatcataaggatatttcgttggcaatgcgtgtacaacaccaatttctccactataaccagcatccttgtaaagcttaacagccttggcatgtgaaaccatcatattgtggtgagattggaataccttagctaagtcatactgaatccctggtgggaacttcccaactagatattgcccatcaccaattggaccgatttcattaaaggttgtccagtaactaacttcagggaattctttgaagcaaaacgctgcgtaattgacgaagtgctcaatattttctcgatttagaaagtcaccattagaatgtagcgtttctggtgtatcaaaatggtgaagcgttacaaatggttctacgtgacgcttatggcattccgcaaataatttatggtaatactctactccctttggattcacttctccaaagcctgttgggaagatacgagaccacgcaattgaaatccgaatgccatttaccccaaactgttcacttagttctaaatcaactggataacgattataaaaatcagaagctggttccgcagtgtaccagtaattatcttctagatacttgtcccacgcaacacgaccttttccatctgtctttgtggcaccctctgcttgatatgcagcagttgctccaccaaatataaaatctttcggtaatgttttaaccatatgcctaccttcttctatcaaaaataaataaaggggtaggagttggagatgataactccctccccttttgattaagaacctgtattcacaagtgaagtgcttgtatatacttgtatataagagatagtttttcgctaatcaaggcgtttttttgagggaatactgactgtattttgaaaaaaactaacgatgagtagctgaaaaactagccttagatggaagtgctgaactgtgaatataggttctaaaactgttgtttgacaaagtcaagagcaccttgaccatctcgtgtgagtttaatgtattgagccccttcagttttggcaagtttaatacccaatgcatcggtttcttgtttaatgtcatcgtagtttgatgctacttgaggtgcaaggatgactaattgatactctggcaaaatctcacggtgcgccccatagcttcctgctgtagctgtaactggaacaccatattcttttgcagctttagttagagcgttggcaagtaatccacttgtaccaccccctgcacaaagtaccaaaacattagtttgttcagaaatttcggtttcgactgcagccttttcaagaatagcatccgccttggcagtattaaaattagctgccactttctctttcaagctattttcaactttccctgattgttcttcagcaagaatttgctcatcataaactttcaagaatggataatagataagtacatcgacaaataccaacaaaatagctagtgcaaaggcaagtggagcaaagtttgttcccattacaatccccaatggtcctggagttgtccatggcaagttaacgctgaaactgttcatttttagcgtatcaacaaagaatttgaaaatccatacgttagcaattggagctaagatgaatggaacaaagaatactgggttgagtacaagtggcgcaccgaacaagatcggttcgtttacaccaaagaaagttggaacaactgaagcacgtccaattgctttatttcgtttagacttagtcaaccacataaacatgaatggcacaaccaaggtagcacctgtaccacccatagtcacgataaacatttgagtacctgaagtcaggattttgtccgcatgttgaccggcttgtaaaagctggaagttggtttcaatattagcataagtaatggctgcaattgctggttccacaatagatggaccatgaatccctacaaaccagaacaaagcataggcaccaaagataattgtaataccaacataaccatctgcagctgtaaacagaggctcaaataatttcagaatcgcctcagcaacgtttgttccaaggaattgacgtgtcacaagatcaattccatacaagacaaagatagacaatgcatatggaatcacatctttaaatgcctgggatacattcggtggaacttcgtctggcatacgaatagtgacattgtttttcacacagaccttatagatattaaccgtaatgaaggctgctagaaaggctgtcaaaagtcccttagttcccatgtaaccattggcaaatccaccttcaataccatcagaagccagtaataagaaacctgaaattgaggcaatcatggttgaaatgaagttaatctgattggtttttggcaattgacggttaaacgcatctgttaaagattttgcggtcgttcctgcaactaagacagctacaatacccattgtataaccgtaaggtttcatgatagctgcaactgcttcatctgaccaagtaaaaccaaagatattaggaacaaaagccaccaatagaaagatacttgagaacaagataaccggcatggcagcaataaaaccatcacggatagcccttaaataagggtttctcgaaatcttttcaaagaaaggcttccctttctcaatgaattcaatcaatttattcattacttatcacctcgtttgtaaagttcaatcatatgactcatcatatctttcaataacaacgttgtcatgagatggtcttgaccatgcatgagcgtcacactaaaggctaaatcctcaccagccgcttctttctgcaacaaacttgtctgagcatggtgggcttcaacaatacaagcattggccgcttcaactagttcttctgcttttgcataatcacctttttgagcagcagccagtgcctccatcaaacgagaacgagcatcaccagcgaatgcaacaatctcaaaacctaataacgtaatttcttctctgttcataatatgaacctccttttaaaattgaattgatttacaataaccgttgaatatgtaacacaatatagaacctttcactatcatttactggctcatcaaccaatgatgtaatcatctcaaaaatctgacttccaacctgatgggctcttggattctggagcttgatgtactgttccaaactagcaatcgattcatttgactgatgggatctatctaagtaattcagaaaataggacaaatgaatcataaagcgatcataaaaattgctattttcttttgagcgtctaatcccattatctatcaaaatttgttcaacctcagcaataattttcttactgatatcatgttcttcacttgtgggatgaattgtttcaccttttgcattgattaagtgaagtgcaattttaccaatctcatcatttggaaaatcatttagcaacttttcacgaaacatagctaaggcttcacgcgccattttatattccaatggatattcggctgaaatattgggtagcctactttcttgataggtattctttaaaaccgcctgatatgcacaatagatatgatctgtcagtgtcacatatagatattcttgtacagggtaatgataagtttctactagatgattaataaccgtgtaggttgccgaaataaaatctaatggaatatcttttaataaggttagaaaattttctttggcttcatcattttttagcgaaaagatattttctatcttgtccttaataattaaatcccctttcttcttttgaaaggttatacctaatcccatcacgactgcctgttccccatgttcatttttcaccagggcagcgttattatttagtgactgtataatcctaaacatatatccctcctatatttttaagcaaaaaaagactacaaacaaaccgagaatatcctactctcaaatccatttgtagtcttgcctaatcgaattagttacaatccactctattcttgctgatgagattattatagcatattctcagaaaatgtaaaccctttcttttaagaaaatggttattttttcaattatttttctagccaagaagttgctgtttgagacaagactacatcaagtccctcgatattttcacgaccaacagttcgtaaccattcacgcgcagcttcttcaccatgttcaatatagactggcacaacacccgcccatgttgcacgaccacaaagaacaccgttaaatttagcacctgcttcatgtgcaaacactagtgtatcttggaagagttttgcagaaacacctgcacttagataaatataaggcaaatgagttgatgcttcttgttgacggaaatattcggctgcttcttcttttgtataaacgacttcccctgttccaaagccttctacaaaattcatgttcacaggtacttctaccttgagaacatccactccaaatcgttcgtccgaaaataccttcatagcctcatttacttttcgaggtttgacttttgcaaattccacactggcattgtcttcaatcgtttcatcgtagctcaaaatttccaaaaagaatggcaaaccttctgcctgacattctgaacctaagcgttcaatataggcatgtttttgaagattgacgtatggatccccatcaacgtcatagtagagtagaaacttaatcgcatctgccccttcttcttttagtcgttttacagaccactctactaggcaatctggtaatcgactagtagagctggtatcatagccagttttttcataagctaaaagtagaccacattgttcatcgcgggcgcgcgatgctggcaaaccaaattcagggtctaacagaattgaggaagaaaactgtgttaattcttctgaaactagtttctttagttcttccatctgctccacagtaggttcttctgtctgatgttttgccatcattcttttcagggctccacgttggtcaaaagctaaagctgaaataatacctgcttcattgcttactttttccatgtattttcttttatctgctgttactaccatattatacctcttcaacttcgatttgagaatacaacgattctgcattttctaaattgacgtaacctgtctgttcttcctgagcatttaacatgcctaaaacattagcattttttaataattctgcttcaggtaaagcatgtaccaaacctgctgcaatacctgcaacagttgaatctcctgatcctactggattgacaactttgatttttggaattctgacacgatagaacttgtcattgtgcttggcaaaagccccctttgctcctaatgagacgactatccaatcaattccttggaaaagttgatcagacaaaactgatttcaactcttgaatatcatcagtaacttctttaccaatcagttgtgataactcttctgtattcggcttaataactgtcggcttctgctggctttctaaaacgtttttcagcgcctcaccagaacaatccaaaacaacagctacaccgtattttttacaaagttctacaatctcaacataataattgctagcaagtcccttaggcaaacttcctgaaatgacaactacatctacattgttcaggacgatttcaaggtgttctataaaattcaaggcttcatgttcttgaataattgggccttgttctaaaatctccgtctgtttgccatcatgaagaatcgcaatgcaattacgtgtttcgctcccaatttccacaaaggaatttttaatatcatttcgagtgagttgtttctttacataacttccaatctcaccaccaataaaaccagtagccactatatcttcaccaatttgtttcaaaactcgtgtgacattgagccccttgcctccagctgttttttgaacttttttctactcgattgaccgtatccaaatgaaaggtatccaagtgataggcaatatcaaccgacggatttaaagtgattgtcaaaatcatgtgagcctcctagtcgtggtattctccacgatcccacttttcaagaaattctgtaaagaactctggattagcttgctcttgattgagcgtttcaactgcagcaatcttttcaattaagcgtttgttttcttcagttggtttgtattctgctttaataaaggcttcaatgatgtcgcacatgagcagctcgcccgtaatctttcctccaaaaccaatgacgttggcatttaactcttcttttgcatagagtgcagaggtcatatcacgaaccagggctgatcggacgccaggtaccttgtttacagcattgttgattccaacacctgttccacaaatacaaattcccaaatctgcttgcccgctcacaactgcttcaccaacttttttaccaaagattgggtaatgagtacgaacattgtcataagtcccaaagtccaatacttcatagccttgatttttcaaataatctaccacagcgattttttcataggttacaatgtggtcacaaccgattgcaattttcatctcttattctcctttgtttacaaccattaacacattttatttagcatatcgacacgaatttggtgacggccaccatcatactcaccttcaacaaatcctttaacgatatttttagcaattccttctcctacaatctcactaccgattgtaataatacgcgaattgttgtgtcctcttgtcatataggcagagcgttcgtctgaaacttctgcaacgatcatgcctttgactttagttgcggtcataaatggaccaacgccataagcatcaatcacaatgccaagatttccttcctgttgattaacttctgcaactactgccaaagttgtatcaacaaaatcacttccatcactgacatctttaaagtcatatgatttttctagcaaataatctttaataacgtcttttagttttgagcccgctggatcagcaccgataatgattgtcataacttatctcctaacaaaaatagaaagttgtagccatatttggcagaaaatctttgttttgcaaaacttagaaaagcgttttcgctttttatgtttaaattatacaaccaaacaaacacaaagtcaacatattttattttatttttgtttgtttttttcgtatacaaacaaaaaaccaacatttctctgttggttttgataactttatgattttgtagaaataatttcaatgtgattacttaataattggtaattttcatcctttgcattcatatctgtcactagagcagttgcatcattcaaatcacaaaaagaagtaaaatcatcttttccaattttcgtggcatccagcagtagatatttttctaaagaatgtttaatggcaatattttgcgtataggcttccgctagggtagaggtcatgacatcagttcccttaagtccgttacctgaaaagaaaatcttgctgaatcgcattttttctaaacttgtattggtaatttctcctacaaaagattctgtcacttgccgatattctcctccaaggagaaagacttgaaaatcctctgtcttcttttgtgataggatagtaaaaacaggcatacaatttgtgatgacagttaggcgaagatttttaatggcctcagccagaaaggccactgttgttcctggacctaaaaataccgtgtctccatcttctatcagttgtgcagccctttccgctatctcttgcttggcttccttattctgaatgtgtttctcagaatgggaatattctcgatattgaaaagccttattacttctagcaccgccatgaatttttgttaagacaccttgctcttccaattcaatgaaatcacgtcgaacagtcatatcagtaacatttagcaattctactatctcagaaattcgaactgtgccttttttgtttaccaatcgtgtaatttcttctagtcgttctcgtttattcatgtttaatcctttgttgtttttttacattatatcaaaaataaacaagaatatgttggaattttgaacattattttaaatgataattacaactttattatgcgagcaatcttcgcgagcaggttttgcgcagttcgcaaaacatcggttcgttagaaccgactgcaaggaaaaaagaaagcattgagttaatccatactcatcgtacactccataactattcaggttcatagcattgttttgcaaaatgggtttcaattaacatttcgccagaacagttaatggcattaggtaatgttgaaaaagatacggaaggttggatagaacttatcaatcaatacttacaatattgtatagagattggtttaagtccatatacacaagctacctacaaagtagcattggccaaagttctcggagtttcctcaactaatttcatcgctacacaaccacgtactcgtgcgaatcgtatgaacaatcgtgtattacataaagactatcgtttatccaacaaaaataacgactactggcataaagtagttacctcgacaggcttacgcaaaagtgaattaatccacgtcactggcgatgctctgcaacgcggccgtgatggccgttggtatttaaatttagccggccataagcatcacacaaaaggacgcagagatcgctggtctccaatcatggccactagtcaagaggaggaagagtggttagtcgctattttccaacgagcaggaaaaaagaaagtctttcatgttcccaaagatttaatcctcgacgattttgatggaaagaaagttccaacagcattaaagtcacacaaatatcctgcagagtatgcagagcgtgtttatcgcagtgtagcacgcgaaatttccaagattagaaatcgtaaagaaattatccatctgcgtaaagagttagttggcatctcgctcgacagaaaagcttgtaaaattgtaacaaaggctctgggacacaatagaccagaggaatttccacattcctatgcttatattttattgaaacgttaggaaacattgtacatttttcaaaaatcaagcctcgatttgttgcacatgtggcataatacttatatctagaaaatgaaaggaattttatatgttacctcaaaataattctcctcttctgttaaatagacaacaagtagcggaactacttggaatagatcctaaatcatttggtaagtacattagaagtcacccagactttcaatgctttatggtgggaaaacaagagcgctatttgaagtcaaaactggttaaatttattgaaagccactgcgattgacggataatgattgataaaattagatttttcatatatcctatatgtgactagtctattttatcaatcattttttatagaaaggctgataaaatgtcaacaataacaaaacgtggtaactcttaccgtgcaactgtatcactttataagaaaggagaatataaacgagaaactaaaacctttagcaacagaaaagatgctgagctttggacattagaaatggaacttgaaaaaggtcgtggcaaaaacattgccgaacgctccaccctatttcctgatttttatagaaattgggtccatacggtcaagaaaactgacgttcgcgaagccacctttattaactataaacgaactctcgtaatagttgatgacctttttgatggtattcaacttaaacaccttgacgatctcgtcatgcaaaagaaaatcgaccaatacgctgaaacccactctaaaaaaacagtaaaagaacttgttcttaaaatccatggttcattaaaatatgcgtatgctcgtggtttgattagtaatgattttggtcatcttttgaaatcaaaaggacaagaacaacctaaacgaaatataccactatctatcacagaatttaaaaaactcagacaatactgcctaagtcatactgaggatgaatttaatgttcttgttgctctcgcccttgagacaggagcaaggcgcggagaacttttaggaattaaaaaagaagatatttttgaatatggtatcaaaattcttcgatcaattagtccaactaatgacgatgcccagcttaaaaccaaatattctaagcgtgatatttccatcaacgaagatgtttatcaagctgtgacaaagcttgcacaaataaaagaaggctatatctttgattgaaatggattcaagcaagctagtcaacttcaaaagctgttaaaacagttgggattaacaaaaacgacatttcatggacttcgtgacacgcatgcctcatttctcttttcaaaagatattagcctagactatatttctcgtcgtctaggtcataactctatcttaacaacacaacagtattatctagaattgatgccagaaaaaagacaccagcaagatgctgaggccttaaatttattgaattcattaagcgagtaaacatttgaaccaatttgaaccaaaaagtcggcacaaatgttgtcgccataacgtttggattaacgttttgagctataattcaaaaacattcactccaattttattagctgaaatataaccctataaacgcatcattagacttctttctttaagattctaagctgatgcgctttttatttatctgttactccaatcagcatgagatgttttcctacaactgtatcggttaactgactagcttaaaaattcctgtccaatttagaaatgcctttcgacgcatttgttcgatttcacagcgaaataatcctgctaaggttgctctatttaaaacaatatcattcttacgagaaaggctagttactttatttacaagcgtatcgacttcttcaccatctcgaattcccatatcccataactcttgaagtactgattttttatacattttctcatattctgccataccttgtagagtccagtaacgttcattattctcaacttctaaccattgccacacaatttctgtatcagctacattaggtttttcatgctgacaggatagacataggaccatctgattagccaggctcgtatccttgctccatttgcttgatacaatctgacacatatttacaccatgagaacttttacatctccagcattttccttcgagcaattcattagcgctcaaaattcctctttctatcaaggtatcattccaatactctgcaactttcgatacttcagctttcttattcaacaaattaaacattttcattctcctactataattacttttctaatatctgtgtccgaaccatactagcctacaacattgctaactcaactacacaagaataatgactcaaatcaagattttccaacaaacgataagatacaaataacttcggttgcaatcatgtgagaggttttgaccatattaccgcttctgactggaattgtttgagtgcctgaaaataaatctgattgactgtaagataggctctaccatttagtaaatatgcgtaatcttgtattaaatctctacaaaataaagctacccaaatagctgcggtcttctcaaaatcagtatcgtaatcggctaataagtccagcgtaatcagacttccttttccaaaatccttcgatttctgatttcgcaatttttcagtatttatcggagtcgccaaaccaaaatgattagcataggtttcccactctttataaatatcattccaagaaatctctgtaatccttttcatttgcgactcctatttttctttttgtgagattatcataacaccgttttgattttttgttaaacacgttaaacaaaatttgcaaaaaatattttttaatggtataattagttaaacagataaggagacaatcatgattttaggtgatattttaaaagaataccgaagcaagaataaattatcaatggataaattcgctgaattatctggtttaacaaaaggttatatttctatgttggaaaagaaccagcatcccaaaaccaaaaaagctctcctgccaacgatggatacgctagaaaaagtcgctaagggcatggctatatcggttggtgagctaatcgagcaactagattccaatcaggatatagctttaacgattactccttcccaatttaaactctttcaacagcctattcatccagaggttctaaccttggacaatgaactaaaaggtgatttccatgcacaatggttaacttttggtcaagaacagttagcagctatgcaaactgcctcagttactccttctgcttctattcttcacttggatgactatcgggagcgaatcgaattacctgttcctggtaaggtttctgccggtacaggttactggcaggatacagatatgaacaatcttgtatcattctataacgatgagattccagataaccaatcttatgatacaatcgctcaggttgtgggagattctatggctccgcatatcgaggatggagactatctcttcattcgcctaactcctcatattcctctaaatacgattggaattttttcagtcaatggggaaaattttgttaaaaagttcaaaggtgactatttgcaatcactcaattctgactatgatgatatctattttagcccagaagacgatattcgacctattggtcaagttgtagatatttatagtccagattgatttttaagcctagttaatcactagttatatatgctacattcatccatctagttttggaaagtctgtccgtatagctggcgttttttcctactgaaaacaaattgaaaagcacagtaaaaggaggctatgacagcctcctttttatatgtcaaattggaaaagtccattaccagatagttatttgacaacaagttaatgattaaataattattctgctacccttatgtctttgattgtcctcttactatttgtctaaagtgtggagattgcttattatgatgaaaatcgctagaggtttttgtgattttctaaggttatgttcaaaagttacaacatcttgaacacatagtagttacgacacgaataatcttagcctacttctgattgaaccgggtagcaaggctaaataatgagttaatgctatgcatttgacaatggatatcacaaatagatataaaacagggataacggacttttcccctactagcatccctctctttttattagagaaagatggctaatagtatatacacttctacgaacgctaaagaactcctttcagcaattcagatggcgttcaacatcttaactaactatttccttttttcaattagattataccactattataaaacgctttcaaataattatgtgctccaaagtcaacttttttgcttttctttttccttgataaagttttcccacattttttgttgcggcttagcaaatgggtaggtaggaaaatcttctacagaaacccatttcaattcttttgattctggaaggttaagtgtttctgccacaccttctaccatttctatctgccatttgcggtgactaaaaatgtgctggacgatgccaaattcttgctcttgccaatcaacagtcagaccataaagttccgtaaagctctgccgaatatctggctgaacaacttcttctgcaacttcaaagagagagacttgtttgtcaacgattgctcctttttccaaaagcggaaaagaccagaaacctgatagaagacctgcttcattatttttttccaataaaaattgattgtctttattcctgatgagaaatccctggtaggccacgggaatcggctttttctttggtgctttgattggatacttatccattgtaccgtttaagtaggctgcgctaaaggctttgactgggctgtcctggggacgtggattaactggcgattcaatatccgaccctagatccattagagcttggttgaaatcgcccggtcgctctgaatcaatcaatagctccatcatcgcttggaaaatcttgcgattggcaggaagaccaatgtcataatcaacctcaaacaagcggctgagaacccgcatcacattgccatctaccgctggttctggcaaattaaaagcaatactggaaattgctccagcagtataaggaccaatgccctttaggcttgaaatggctgcatgcgtggtcggaaattgcccatcaaaatcttctaccatttgctgagccgccttttgcatattccgcacgcgcgaataatagcccaatccctcccagagtttgagaatgacctcctctggtgcttgtgctaaatcactaatcgtaggcaagtgatggagaaaacgttcataataaggaatgaccgtgtctactcttgtctgttgaagcatgatttcagaaacccatatagcatacggatccttggtccgtctccaaggcaagtcacgtttattggcatcataccaatctaagagtgctttgcgaaaagcttgaatcttttcctccggccacatttcgattccatattctttcaaatttaacatacatctagtataacacaaagaaagggagccagcttttgccaactcccttatatcgtttataatcaaaatcaaactagctccaaaggtttggggaacctttggaggttggaaatagagcgaacgaatttgtttttctaaatctagccaagactgtctgcttttgatgttcgaagagttttattctacttttcctgttacaaacatggtaaaacttgctgaagcaagtagctgtttatcttggttttctatcttaacttcgacgacctttgttctacttccatcatgtgtgcaagagcctattactgataaggtatcaccaagtttagctgccttcatataatgaatattggactgtagggtgacagaataagaaccacttgctaccgttgtcagacctgcaactgaatctgccaatgtgaaaagaaagcctccatgtgccataccgtatggattgagagatttttccgtcacctttgtggtcattagcacctctttctcattgagcattgtagcttgatagtcatctaaaaccgtaatcggttgtaagtttaatttatctaacactttcatcctcctctgtctgctgacttgtttgcatttgataataaacgccttgttcagccatcaacgcttcatgattcccttgttcaacaatttttccatccaccatgaccaaaatcaagtcagctgattgaatggttgataggcgatgagcaataataaaactggtccgtccttccatcaatttggcaaatgcttcctgtactaaaatttctgtccgtgtatcaatagaggaagtcgcctcatctaaaatcaggattttaggtatcttgacaaagacacgcgcaatagacaaaagctgacgttgtccctgggataagccttctcctccatctgccaaaactgtatcgtagccctgcggaagctgacgaataaagaagtctgcattagctgccttagccgcctcaatgaccaattcccgcgtggcatttggatagccataggcaatattatcatgaatggtaccagatttgatccatgtctcctgtaaaaccatcccaatctgtctgcgaagatcctcacgactatactggctaatcggaaccccatctaagacaatctgaccagccgtcacatcgtagaagcgcataagaaggttaatcatggttgatttgccagcaccagtaggtccaacaatggctactttttgtccagctttgacagcaatgtccaaatgttctatcagagaacgttcagggctatatgagaaagacacattgtcaaaggaaatagctcccttcaactcctctgaatcaattttccgctcagcctggtcgtcaatgctatctagagccaagatagcaaacagcctgtctgcacaagctaaggcgctctgcaattccgataggaccgaggaaatatcattaaaaggcttgctgtactgactagcataattgaggaaggttgtcagggatcccactgtaaaatttcctgccataattcttagcgctccaagtcctgcaagtaaggcataaataatagcattgacaaagcgagtacttggattgaccgttgaagaggcaaagatagcctgttgggaataggtcgcatactggtcattcacaacttgaaaaccttgcgtaaattgctcttgagcattgaaagattgaaccagtgtcaattgactgatggactcttccaaaagctgagattgcctcccacgtgcctgagtctgttgcctataataaccataggatttcttagcgatatagcgtgccacaagcagagaaactggagtcagggcaacaacaaccaacatcatcgtcaagtcaagcctagccatagtgaaaatggttaggaaaatggtcgagataccaatgaaaaattgattgaaaatcatcaagagaccatttgttaattgctcgctatcacttgaaaaacgagccaccaagtcaccgactgattgacgatcaagataagataagggcatctggtgcagcttcacatagacctgttcacgcaagtcggccaccattccgtaaaccaagcgattggttaccaaaggtaagtaccattgcaccagtgtattaagcaagataaccatcaccattttgcctaagataccgagcaagacctgaccatttgctatcaatactgcatcaactgcctgaccaatcaagataggcagataaactgtcagaaggacttgcaccaaagttcccaccaacatcaaggacattcgaaggggctggtgtagaaccaatctgaccagttccttaaaactagattgtctcatagctatcctcctctccttgttgttgcgattggtgaatttcttgataaatagcagagcttctcagcaagtcctcatggcgaccaagtccaacttgacgcccttgttccaagaccaaaatctgatcagctgtccgtaaactattggttctttgtgacaccatgattaagttctgacctggtaattcctggcgaatagcagctaataatcgactctccgtcaaataatccagagcagatgttgcatcatctaagattaaaatcggtgctttctgtaaaatagcgcgtgcaatggtcaaacgttgacgctgtccactagaaaaattcttcccaaaggcttcgacagggctatccaaaccacctttatcctctatgaaagatttagcctgtgcaatttctaaagcagaccataggtcactatcagatatttcttccaatcctaaagataaattagaacgaatagttccagcaaaaagctgggcctgttgcggaacgatggcaattcgctgccgccactcttttaaattcttaggactttttccatcaatgaagagagagagctgatttgttggcactgaatagagtgcctgcaataaatctactagggtggacttacctgacccagttcccccgataattcccataaactgttccttacgtaagtcaaaagtaatgtcagacagggactcctcagcagattttggataagaaaaggaaagatgacgcacagaaaagatgatttccttatcctcactaaccacttttggcaaactagactctacatcctcagatgtttggtcaaacacctcttgaatacgttgcgctgaaatataggtctggttgagagtagacacgaccataatcatcttgaccaattcgactaaaatttgaagaaggtagttgataagagcgaccaacatcccctgttccaacaaattgtgtgaaatggctatatttccttgccagatgagaatgagtaaggtgctgttgaccaccaaaaatgtcaatggcgataaaagactagaccaaaaaccagcctgcaactgttgcttcttataaatctgatttatgccttgaaaagccttaatttcccgctctctttgtccatatgcacgaatcactcgccaaccagtcacggtctcacgtacctgccccaccaaaccatctaattcttttcgcatcgattgataaatacggctggtcataacagaaatgactgtcactataaaaatcaataggataatcattcctagaaaataggcagatagacttgggctaatatagaatgccatgatgagcgaaccaaatacgacaattggagcacgtaaaaacaaacgaagaaaagtattaatacccgtttgaatttgtaaagtgtcgctggtcaatcgtgtcagcaaactggatgaggaaagaatatctcggctagacttgggaagggaaagaaccttctgatacaagtcattcgtcagctctttagtcactccaactgctgctttagctgaataatattgcgctattagtgaaacaataattccaatacatgctataccaaccagtaaaaaaagcatagcaaccaggtttccctggctgccatttggaataattgtatcaacgatataggcgataattaatggtaccaaaagctcaaaacaagcttccaatagtttaaaaactggacctaatatggattccttaatatagtccttaaaatatcgtgataaaaatttcatattaacggtgctccaaagcctgaaccgcagtaatcaaggtcaagttgtaaacatcatcagggttacaaccacgagacaagtcgtttacaggctgattcaaaccttgtaaaacaggacctaccgctgcaaatccacccatacgttcggcaattttataaccaatattcccagctgagatacctgggaagataaatacagtcgcttgaccagcaacactcgaacctggtgcttttaatttacctgtagcagggacaaaggcagcatcaaattgcaattcaccgtccaaatccaactccggacgcaatttttgagcaattttagttgcttcaaccaccttatcaactttaggacctgagccagatccttttgttgaatagctgagcattgcaacttttggatcaataccaaacattttagcagtacgtgctgagttgatagcgatttctgccaaggtttgagcatctggatcaatgttgatagcacagtcaccaaaaatataacgctcttcaccttttaccatcaagaaggcacctgatgttttcgatacacctggctctgttttaatgatttgaagagctggacgaactgttgaagcagttgaatgaatcgcaccagataccataccttctactacgcccatatataccaacataacaccaaagtagttcacatctttcaacaactcatgtgcctgctcttctgataccttacctttacggcgctctaccaaagcagctaccatctcatcatatctatcataatgagctgggtcaataatttcaaaaccttctgtaatcccttcaatgtcaaggtaaatcttaatacgatctgggtttccaagcaagacgggtactacatccgactcatttaccaaacgttttgtcgcctgcaagatacgtggttcttcaccttctggcaatacgatacgtacttttttaccctctagctttgtagctaattgctcaaaaattttcatgaacaaactccttaaatttatttacttattaactgattgatgacagcctgaaaatcctcaggaagcggtgcttccaaatcaatcctttcggctgaaaaaggattgtcgaaggccaaattatgacaatgcaaggcttgacgttctatcccacattccaaacttccaccatacatatcatctcctaacaatggaaatccaatgtgagaaaaatgaacacgaatctgatgagtccgcccagtatgtagttgaatatctactaaatgaatatctccccacgattgcacaacacgataggaagtatgagcatattttccattctttgtcacacaacgggtaatgatgctgtcttctggacgaccgataggggcaataatatcccctgtctcttctagctgcccattccccttcaccaaagcataataacgtttatgaataagcttggcctgtaactgcttatcgagtcgtgcatgggcatagccgtgcttggcaaacagcatgacgcctgatgtatccctatccagacgagtcacaatatgaacctgcttattctcataattctgctcaataagataaccttttacaaaatttgcgattgtggatgaatgcaaagcagaaggaatggaggcgtagccaaccggcttatttatcgccagaaaatgatcatcttcatagacaatatccaacggaaagaaaatcggttttaaactaccagtcaaatcctcttcagcaggtatgtcaattgtaaccctatctccaatatctagcaagtaagttgcattttgctcaatatcgttgacccaaatattgccacctgtgtacttaattttggccaacaaaccttttgaaacaccatgttttttcaaaaaagtttttattttagtatgctggtcagcaatgaattcaaaccgcattactccacctctccaataaaggcgtccttaacccgattccaaaaactagtatgactcggtgttgcaacaaaatgaatcttactattgtctatctgatactctatactttcaatactatcatagacaaaagtcttattgtctaccgcaatcgagtaacggtcactatgctttggttcaatcacaatcttgtcttttttagggacaacaacggatgaacccaaggtgcggtaaacacgattgttcaaacttgccacttctgcaatctgcaatgcctcgattgttggatgtaaaacagcaccacctaatgacttgttataggctgttgagcctgtcggcgttgaaaccgaaattccatcccctctaaagcgttcgaagggcacattgttaataataatatctgcgaccatggtcttagaaagacgttttactgtcgcctcatttaaggcacgcgcctcgacaatgcgaccatctgtcatcttgatcttaacatttaaaatcggatacgatactctagcacctgtatcaagcttaagattttcaatcagcttgtccacttcaaaatcgcgataatctgtataaaaccccaaatgacccgtgtgaattcctacaaaacgtacacgatcaatcaacttttcatatttgtgaaaagcagataaaagcatcccatctccaccgatagaaatgacaatatctggatttttaggagtcaaaataaaatttgcttcttttaactttgtccataattctttggacaccgcttcactcttaggatttcgactagcgagcagagcgattttttttctacctgtattcttcatctgtatcatcactgttgcccacaccgtcattcagtttgcgataggcaggatcaaataaggcctgcgcttcttgaatgtcgttgcggatttttcgcatatcctcatctaattcataagcaatttttgctgtaacttccaagcgtttcttgatttcttctggaaaatttcccttatatttataattcagagaatgttcaattgtagcccagaaattcatggaaagggttcgaatctggatttctgccagaaccgtctcgttgccatttatagtatccacaggatactcaatcaccacatgatatgaacggtagccagaggctttcatattattgatataatcccgttcatgcacaatttgcatatccttgcgtttccgcaaaatagctaatacttcttcaatgtcgtccacaaattgaaccataatccgaagaccggcaatatcttgcatatcttgagcaagattttccaatttaatatgtcgcagagccattttttctttaatggattcaatcggttttacccgtcctgtgacaaactcaattggagaatgccgattagccttgcgatactgcttgcgaatcccccgcagtttgattttcaattcaccaactgtctgaatataggggtctaaaaattcttcccagttaaagtccatacggcccctttcttgtcaaaacttttaaattgtattagaataacacaaagactaatctattataacacattgaaagggtttactgcatgaaaaaccaccttgaaattgagtataaaaccttactgaccaaatccgaatacaaacgcctgcttactgacttttcagatgtgagcccaattcttcaaacaaaccactacattgataccccagacctagatatgaagaatcaccgcttttcactccgtattcgtacatttgaggactcagcagaactaaccttaaaaattccacaagaagtcggcaatcaagaatataaccaagttctagacatccaaactgctcatgatttactggaaaattttcaactaccagcaggacaaatttctgacattatttctgcaaccgaaattccacttgataaacttgctgtctggggaatcctcacgacaaaacgctatgagaaacagacatctataggccttatggccctcgatgaaaatgattatgtgggacaaaaagattacgaattagaagtcgaagtgaccgatgcagatgcagggaaaattctttttgatgaattccttaagaagaaatcaattcaattcaaatatgctagtagtaaggtcgcacgaactgctgcccacatgaaataactataaaaaatcagccaactaaggttgattttttagtttcactactgaaaatttttcatttttttgatagaatagaactatctatcgtaaaaaatacttttatgtcatcataaaagctcagtgtgtaaaaggagttactttaaaatggtacaaccactcggtgaacataacattaaattattctcactcaatagcaaccgtgatattgctgaaaaaattgctgattctgctggaattcctcttggaaagctgtcttctcgtcagttttctgatggtgagattcaaattaacattgaagaatctgtacgtggcgtagacgtctacattatccaatcaacaagctatccggtaaataatcacttgtgggaattattgattatgatcgatgcttgtaaacgtgctagtgccaacactattacagctgtcatcccttatttcggctatgctcgtcaagaccgtaccgcttctccacgcgaaccaattacagctaaattagttgcaaatatgctggttaaagctggtgtcgaccgtgtattgactcttgatttgcacgcttcacaaattcaaggtttctttgatattccagtagacaatctccttacagaaccactttttgcagcctactacatggaaaaaggactctgcggagaagatgtcgtcattgtgagtcctaaaaattctggtatcaaacgcgcgcgtaatatcgctgaatttctaaatgcaccgattgcgattatcgactacgctcaagatgattctgagcgttctgaaggctatattatcggtgatgttgcaggtaaaaaagctattttggtggacgatattctcaatactggtcgcactttctcacaagcttcaaaaattgtccaagaaggtggtgctactgaaatttatgcagttgccagccatggtctctttgcaggaactgcagcccaactcttagatgaagcaccaatcaaagaaatattagttaccgattctgttgcaagcaaagaacagcatcctaaaaatatcgccttcctaacagctagtgacttgattgcagatgccatccaccgcatccaagaacatcagccactcagcccacttttcaaatttactagtcctgaaaaagaaaactaggagtaactctttgatttatttagataatgcagcaaccactgctctatctcctactgcactccaacggatgatggaagtggctcaagaaaattatggaaacccctccagtattcatcaaagcggtcggaaagccaatcaatgtcttagacaaagtcgtcaagagattgctcagattctctccgcctctcccgaacaaattattttcacatctggaggctccgaagctgatactttagctattcaaggctatgcacttgcgcatcaatccaaaggaaaacacctgattactacggctatcgaacaccatgctgtcctccataccatgcagtatctagaggatcggtttgggttcgaggtaacctatatccaaccagtcaatcaagtaatcaccgctcaacaaattctggatgcccttcggccagatactattttagtcagcgtcatgtttgctaacaatgagaccggtcagctacttcccatcaaggaaattggagagctcctagccgatcatcaggccgtctttcatgtagatgctgtccaagcaattggaaaaattgcaatttctccctctgactacggaattgacttgctcgcggcttctgcccataaattccatggtccaaaggggatgggattcctgtatagtaaagttcataaatttgattccttgatccacggcggaaagcaggaacagcaacatcgagcaggtactgagaatctccctgctattgctgctatggcgactgccctaacagaacaatatgagtccttagatacgcatcatcaacatgtcagtgaactgcgacaacatattatcgagggattgtctggcttagactattatctcaatcaggctggacctcatctccctcatgtccttaatatcggttttcttggtaaacttaatgaacaactccttatgcaactagatttggcaggtattgctgtttctagcggttctgcatgtacggcaggtgttgtccaaaatagccatgttttagaagctatgtatggaaaagactcccatcgtctgaaagaatccattcgtatcagcctatctgaaatcaatacaaaagaagagatagatactcttatcatcgaactaaagaaaatacttggaggttaaaatggcattccaacaatcagttaccttaaaagattgtaattttacttatcacattagccctgctatcaaaaaatatacactccgtgataacacctttgaacaaaccaaagcaggtcactatcagcttacacgtcttctggaagaaattccaaattcaaaccaaggattcctcttgaaaattattatcaatcaagacctaactggttttaaaattaacattaccgacaagtctggtcttcatctggtaaacatttttaagccagaaagtaacaaggttattcaagaaaaattctatttcctcatggatagcttgattgaccgtgacatctttacaaaagagagttagtatgattgaaattcactatcttgacgcttacaagcaagaacgtatccaaacatttgagaataaggatgcagccattctggctttttccggttgcttaaccctcccagactattatccagttaccagcattacacaaaacggacaagctctggattacaaagggacaatcggagatctctatcgctatttacaaacactagattagacagtttcctgtttaatctttttttaaaatcaatctgttgattttttcacaaacttggactagaatagaataaagaactgtttaatatataaataatcgataaagcgtattctatcgaaataaaggagtctaaagtgaaaaacgataaaaaatctgatattccacgcgctactgccaaacgtctatccctctactatcgcatttttaaacgtttctatgcaggaaatattgaaaaagctagttcaaaagaaattgccgaagctatcggaatcgattcagctaccgtccgccgagatttttcctattttggagagcttggtcgtcgtggctttggctacaacgtcaaagagttgatggatttctttgcggatattctaaatgatacctccatcaccaatgttatgcttgtaggtgttgggaatatggggcgggccttactacactatcgcttccacgaacgaaataaaatgaaaatagtcatggcttttgaagcagatgataatccagctgttggaacgacagatgaaaatatcccaatccatgcaatctcagaaatcaaggaacgtatcagcgaagcaaactctcagaccgccattctaacggtacccagcgtcaaggcacaagaagtgaccgatattcttgttgaagctggtgtcaagggaattctgagcttttcaccagttaacttgtctgtcccaaaagatgtcgttgttcagtatgttgatttgactagtgaattacagacactactctactttatgcgaaaaggataagcaatgaaaaaaccagttattggtatttctggaaatgaatataaaacaggggatcatacagaacccctgctttcttatacccagacttgcctcgtacaagctattgaagatgctggtgggctcccactcatccttccagctacagagccagatttggcaaaatattatattcatcttattgacaaactcatcctaacaggaggacaaaatgtccagccaagttactatcacgaagaaaggactattgacagcgataattatctaccaaagcgtgacgagtttgaattagccctcataagggctgcccaagaaaatcagaaacctatcttcggtatctgccgaggtctacagctctacaatgtagctcaaggtggtagccttcatcaatcaatttctgaacattggcaagacatagacggacaagaagtcagtcaaacgattcaactgactcaaaatagtccactttacgacatatatgagtccgatccgagtgtgaactcatttcaccgtcaggctatcaaagacttagcccctgacttagaaatcattgcactatcagataatcaacagattattgaagcagttcattcagcctacccaactaaatttttaggggttcaatggcatcctgaactactctacggtaaacgtgagattgaaaaagacctcttccactatattgtcaataaactttaaaataactcactttcttctctaaaagaatagtaatccttatttccaacaattaaatgatctaataataccagtcctagcttttcgcaggactcttttaaattctccgtaaatagcaaatcattcctactaggttgtactgaacccgacgggtggttatgaacgatgataatcgatgttgccatacattttactgcgtaatgcaaaatttcacgtggttctgcaatgctacgattaacactcccaataaaaatcgttttttgactgataatctggttctgtgtattgagataaagtgcaactagatgctcctgcttcttatgcccgatttcatgaatcatcttacgtcccaacttctcacttcccaaaattctctcatttaagagtagctctgattgattgatacgttttccaagttcaatcatagccttaatttcaatcgccttgacgcgcccaattccagtcaaactttgcaattcttcaattgatagttctcttagagccgctaaactctccaaacgattcaataatttattggagagaatagaaacaggttctttttttgtcccagttctaataaaaattgctagtagttcctgattactgagacgctcagctccaacttctactaaacgttctctaggtagaaaggcctcttctttaaattcaatttgatacataatttcctcctcacctatctattcgtaaaatcttgcaaaaaagaagccatataaaaccaaagattatctcctcagtcctataccacttctttatccttaatatatagatgttttattgtccataatcatactgattataactcttattgaaggaatctaagatgtcttttgccgtttcattatatggagtggttgattcaagaactccttttacaacaatacgttgcgtagcataatagtccgtacatgtcactaacgtaacttctgtacgtccttctacatcatcaatgacatagacactttcaggcgaaacaatttccacactatcaataacgtaggtgtaaacattggtcttgtcagtaatatagattttcatgccgtttttagcacgatcaagcggtgaaaagagaacatctgccgcaccagttacaccaaaaatatggtggctggccaacgcataatttcctttccccatctcttggttttccttcatggtaccagctccatacatgagcgaagtattgaagacccctttaaaaataggaaggttgataccaagctcgggaaccgcaatcccaccaattacaggtaagcgttgtgcatcccactgagctgctaaaatagcttctgtagaaatagactgaacctgttcgaaatcaaatgttgtctcagcctgtttattcttttcgatatcctctgtcgtaacattgctaatctggtatttattcgtattccagccgataataaaattacggatagaggtgttgaatatcaatgccaaggaaatcagtatcaatacaactgttaaaagattgcgccaaaaagaacctttacgcttcttcttgttttcacgttttgacatgactatttattccttttcttctttaatttcggcagcatctaccaaggcaaaggtcatgattttcgcttcaccattcaagcgcatcacttttacccccatggttgaacgaccagtttgagagatattggcaacacttgtacgaataatcacaccagtatcggtaataaccataatatcttcatcaccagataccgttgtcaaacctgccagagaaccattcttatcagcaactttaagagtcttgatacccttaccaccacgacctttggttggatactcactggctggtgtacgtttaccaaaacctttttccgtcaatacgagtacttcttggtcatcagaaatcatagtagcgccaactaactggtctccctcacgtaaattgataccacgaacacctgttgctgtacggcccatattacgaacatctgtttcagtgaaacgtacagaataaccgaacttagtccccataataatgtctgcttggccatttgttaagaaaacattgatgagttcatcgtcttctttcaaattcaaagctttcagaccgctctggcgaatattggcaaattctgacacactagtccgttttacaacaccttggcgggttgcaaagaagagatagctatctgcctcctggtccttagttacattgataatggtttgaattgcctcgttttcttccaatttaagcaaattgaccactggaagtccctttgcagtacgaccatattctgggatttcatagcctttgagacggtaaacacgtcccttattagtgaagaagagcaagcgatcatgagtgcttgtagagactaattctcgtacaaaatcatcatccttgacgccagttccttgaaccccacgtcctccacgcttctgagcttgaaactcatcctgtgccaaacgcttgatgtagccttggtttgacaaggtgattaaaacatccgtttcttcaatcaagtcctcatcttcaagggatagaacttcaccaaccatcaattctgtacggcgtgggtcagcatatttacgtttgacttcttctaattcgtctttaataatctgaacaacacgctcaggcttagctagaatgtcagccaaatctgcaatcaaggccactaactcatcatattctgattgaatcttgtcgcgttccaaacctgtcaaacgacgaagacgcatatcaagaatagcctgactctgacgttcagaaaggtcaaatttctccatcaattcagcttgagcaatagcatcagtttctgaattacggataatacgaatgacttcatcaatatggtcaagagcaatcagcaagccttctaagatatgagcacgcgcctcagccttttctttatcaaatcgtgtacgacgagtgactacttctttttggtgttcaatataagactctagaatctgacgtacagaaagaattttcggtacaccattttggatggccaacatgttgaaactaaagttggtttgaagctgtgtttgcttgaataggttattcaaaataacgttagcagaagcatcacgacgaacttcgataacaaatcgtacaccctcacggttggattcgtctcgaacagcagtgattccttcaatacgtttttcttggactaatttgacaatatgttcttgaaccttggacttattgaccatgtatggaaactctgtaacaacaatgcgttcacgaccatttccatattcttcaatttctgtgcgggaacgaagaactattgaacctttaccagtttcataagcacggtgaattccagatttccccataaccaaggcacctgtcggaaaatctggtccaggcaagacttccataatctcacgtgttgttacctcgggattgtccataaccagcttaactgcctcgatagtctcacccaagttgtgtggaggaatgttggtagccataccaacggcgataccagtcgttccgttaaccagaaggttagggaaacgagcaggtaaaacctcaggctcacgttcactcgcgtcatagttatccgcaaaatttaccgtgttcttgttaatatcacgaagcatttcaagcgcaatcttgctcatacgtgcttctgtataacgctgagcggctgctccatcgccatccatggaaccaaagtttccgtgaccatcaactaacatgtgacggtagctccaccattgtgccatacgaaccattgcttcgtaaatcgcactatctccatgcgggtgatatttacccataacatcccctgtgatacgggctgattttttatgtggtttatccggtgtaatccctaattcattcatcccatacaaaatacggcgatgaaccggcttcagaccatcacgtacatcaggcagagcacgtgaaacgataacactcatcgcatagtcgatgaaggatgatttcatctcattggtcagattaaccgttactaaatttttatcttgcattatatgcctctttcaacagtcattgtgcttctattataccatattggcgaataaatttctttgttggaaactagcatgtaaacattttcaaaggcgctttcacaagtgacaaaaagcttaaaacatgctagaatgtattatggttgggatgaagtcatccccaaataaaactaaggagatgtttagcaatgactgcaactaaacaacacaaaaaagtaatccttgtcggtgacggtgccgtaggttctgcttatgcttatgctcttgttaaccaagggattggtcaagaattgggtatcatcgatatcaacaaagaccgtactcaaggtgatgcagaagacttgagccacgcattggccttcacattccctaaaaaaatctactctgctgagtattcagatgctcatgacgcagacttggttgtattgacagctggtttgccacaaaaaccaggtgaaactcgccttgaattggtagagaaaaaccttcgtatcaaccaacaaatcgttacagaaatcgttaactctggtttcaacggtatcttccttgttgctgctaaccctgttgacgtattgacttactcaacttggaaattctctggattccctaaagagcgtgttatcggttctggtacttctcttgactcagctcgtttccgtcaagcattggccgagaaaatcggtatcgatgcacgttcagttcacgcttacatcatgggtgagcacggtgactcagaatttgcagtttggtcacatgccaacgttgccggtgtgaaattgtacgactggttgcaagacaaccgcgatattgatgagcaaggtcttgttgacttgtttgtatctgttcgtgatgcagcttactcaatcatcaacaaaaaaggcgcaacttactacggtatcggtgttgcacttgcacgtatcactaaagcaatctttgatgatgaaaatgcagtacttccattgtcagtttaccaagctggtcaatatgaaggtgttgaagatgtcttcatcggtcaacctgctatcatcggcgcacacggtatcgttcgtccagtcaatatcccattgagtgacgctgaattgcaaaaaatgcaagcatctgctaaacaattgaaagacatcatcgatgatgctttcgcaaacccagaaattgcagctggtgtaaaaaactaattatataaaatagtaaaaaaggtgagcaatagctcgccttttttaccttctaatatcatagcgtaacatagcaattccatctgtgacagttgactctaccaagagcaatttcttttcttccaaaagtgaggcgaaaagtggaataccgtcacccaaaatagtaggaataatcccaataataaggtgatcaatcactcccgcctctaaacagtcctgaaccagacttgctccaccaaacaaccaaatatctccaccttctctagaacgaagttccataatctacccgatgatgtcccttacgaaacgcacattaccatagtccgtctgctcggtatgactcgcaacgataaattgcttttcctgatatccttcaatcatttccaacggacaatcttctaatgattttctccccatcacaactgtatcacagttgttaaagaatttttgattatcaaactgtaagacagtatcgtatttatcggtaccatgcccttcaatccaatcgtagcttccatccttacgtgcaataaatccatctaaactcattgcaatatttaacaccaatcgtctcacaattaatctcatttcataccttagtgacaaactattataccagtcattctccctattctcaactaaaagtccctctagctcctcttcctttgaataggacaattattcatttcctgtacagcaaagaacatgataaaaaggtccactggacctttttatttagatttgatatagttgataccgtctgttttaggagcgactgctttaccaaagaaagcagacagagcaataacagtaatcaaatacggtgcaatttgaagataaaccgttggaatatctttcaatcctggtaattgtccacccactactgccaaactttgcgtaagaccgaagaatagactggcaagcatagcgccaattggattccacttaccgaaaattacagctgctagagcgatgaaacctgaacctacgattgttgttgcagagaagttgatattcactgattgagcacttacagctccaccaacaccaccaaggaaaccagcaatcaacacacctgcataacgcatagcgtagacattgattcccaaagtatccgctgcctgcggatgttcacctactgaacgaaggcgcaaaccgaacttggttttataaaggatgaaccaagcaagaaatgctgttgcaatagctacataacccatcaagcttgtatttttgaagaaaatttcaccaatgattggaatatctgccaagatagggaatgaaaatttaccaaatgattcagtaatactatcagtttgacccttattatagataaccttgactaggaaaactcccaatgctggagccaaaaggttcaacaccgtacctgatacaacgtggtctgcacggaaattaatcgtcgccatcgcatgaatagcagcaaagacaacaccagcaagacctcctacaataacagctaataatggagtagcattaccaaatgtccctgcaaattcgatattgaaaacaacaccagcaaaggcaccgataaccatgattccttctagaccaacgtttacaataccaccgcgttcagagaaaactcctccaagactggtaaagattaagggcgctgaataaatcaacatttgcgaaatgagtaaggcaagaattgaaacattcatcttatttcgctcctttcgctttatttctagattttaataattgttcaaaaataaatttcacaccgataaagaaaatgattgatgccgtaaccacgttgatcaattcaggtggaatctgtgcacgtaccatacctggagcaccgacagaaagaacaccgaatagaaaggcagccaatggaatacctaacggtgaattagaagctaaaagcgctactgacataccattaaaaccaatatccaagttaccactttggatataaacgttttggaaagtacccaaaccttggatagctcctccaagacccgcaagagcacctgaaataatcatagatagaataatcgtacgtttcgcagacatacccgcataatccgatgctgttgggttaagccccactgagcgaatctcaaaaccaagagtcgttttggtcaataggaaccaaatcacaaaaactgcaataatggcaaagaaaataccaatattcatacgtgagttatctgtcaatgcacggagccactctgtttggtaagaggcatttgctgacacgttaactgtcgagtctgtatttttcatcaaactatctgcaaatacatcacgaatgatatagttacatgaatagagtaagatgtagttcatcataatcgtaacgataacttcacttgttcccaaataggcacgtagaatacctggaatagctccagcaataccgcctgccaacatggcaattaagactgttcccaaaatcaaaactggacgtggtaagtcaggatttgccaaggcaaaccatccagcaaaaacccaaccaacataggcctgaccagacaaaccaacgttgaagaaacctgcacgactagctactgcgaaaccgagagcagtgaaaacaagtggtgccattgcacggaaaatttcaccaattgatttgatattaccaaaagctgaatagaataactcttcatagccccaaattggatcgtagccaaaaacaagcatgacaatcgctccaagtaggataccgctgaccacagccattaatggaagggccaaattcttatatttattaagcatgttcttctcccttctcaatatgtccacctgccatcaagacacctaactcttgtttattggtcttagcaggttcaacaataccatggatgacaccatcatggataacagcaattctatctgatacatccaaaatttcatccaattcgaagctgacaacaagaacagctttacccttatcacgttctgcaataagacgcttacgaatatactcaatagcaccaacgtccaaaccgcgtgttggttggctaacaatgaaaaggtctgggttgcgatcgatttcacgcgcgatgatagctttttgctggttaccgcctgaaagagccttgattgggacgagttcacttgccccacgaacgtcaaattcttccattaacgcgcgtgctttttcattaatgatattatagttcaagataccattttttgaaatcggttctttatagtaagtttgaagcgcaaagttctcagcaacagtcatcggaagaacgagtccatcacgatgacgatcttcgggaacgtggctcacttgcatttctgtaattttacgtggagttttaccaactacttcctcacctttgatagtgattgagccagattttaccttacgtaaaccagtgattgcctgaatcaactcactttgaccgtttccgtcgataccggcaataccaacaacctcacctgctcgaacatcaagcgataagcccttaactgctggaataccacggttttcattgacaaccaaatccttaattgacaaaatgacttctttaggactcgcttcaactttctctgttttaaaggaaacggaacgtccaaccatccactcagccaaatcttggtttgttgctccttcaacggcaactgtttcgattgatttacctcgacgaataactgttacactatcggcaactgcacgaatttcatccagtttgtgcgtaatcaaaataatagatttaccttcttcaaccaaggctttcataattttcaagagctctgcaatttccgcaggggtcaatacagctgtcggctcatcaaaaattaaaaggtctgctccacggtaaagtgttttaaggatttctacacgttgctgtgcacccacagaaatatctgcaacctttgcagttggatcaacttcaagaccatatttagcagaaagttctttaatttctgcgatggcttttttaaggtcaatcacgccacctttggtggtttcagaaccaagaatgatgttctctgcaactgtgaaagcatcaaccaacataaagtgttggtgcaccataccaatacccaattgggctgctttggatggagagtcaatcttcacggattgaccgttgataacaatttcaccgcttgtaggttccaacaagccagcaagcatgttcatcagagtagatttacccgcaccattctcaccaagaagggcatggatttcaccacgtctgacattcaaattgatgtggtcatttgctacaaattcaccaaatatcttagtgatattgcgcatttcaatgacataatccttagtcataatctattatcctttctgactatagccttctgaaaattcttcagtactactttgagtacttaaaaactcttcatcaactataccatttttgtcagtaaaacctaccatagctgataggctttactgacaaaaatctcagcccgaaaacggcgccccgtcgggtcgccgaatcggaattgtcgaaaagaaattcattaaggtttttcaggaacttctactttgccatccaaaattgcttgtttagcatctgcaactgctttagaagcatcttctgaaagattagtttctgccaattcaacacctttatctttcaatgagaattgaagtacttgaccgccagggaaatcacctgcagctgccttagttgcaatatctttaaccgaagtaccaacttgtttcaatgttgaagccaatacaaagttagaagatttaccatctttagaagtgtatgtaccttctgctgattggtcacggtcaacaccgattacccaaactttatctgcttcattacgagtttcgttttctgctttagcagctgcaaatacaccgttaccagtaccaccagaagcgtggaaaataacatctgcacctgcagcatattgagcagctgcaagagtttgacctttagcagcatcaccaaatgaacccgcatagtcaactgtaatcttgatgtctttgtttacagacttagcaccagcaacgaaaccagcttcaaagcgatcgatgataacaccttccataccaccaatgaaacctacgtgatttgttttagttgatttagctgcagcaacaccagcaagatatgatgcttcatggtctgcgaaacctacgctaactacattgtcttgatctggaacaacactatccacgattacatagtgtgtattaggattatttggtgcaacctcagcaatcgcactctccaaggcaaaaccaataccgaacacaagattgtaaccaccagcaacagctgaatcaaggtttgtgatataatctgattcactagctgattggaagtaatcgtagccattacctttggaaagactagctgctttaccccactcttgaagaccttcccaagcagattggttaaatgaacggtcatcaacaccaccaatgtcagtaacgatagcagctttcacagatgtgtccgctgatgaagatgcttctgagctactgctttttgaagcacggttaccacatgcagccaaagatacagccgcagcagctgctagacccagtccaacaagtttcttgttcatttctgaaccctcctaaaaatctttttgcaactacattgttgcagagtaatattgctacagtcaaatgactgtcatacagactacgttaagtctgtaaaggaatatggtagtaattccccgactgtcgtctcgactgtcgatttatctttagcgaccaaggtcacttttaaatccttatcaaaaaattctgccataacttggcgacaagctccacaaggagatattggtttttctgttttaccataaataatgatttcagaaaaatctttcacaccttcagaaatggccttgaaaatagctgtcctttcagcgcaattggtcaaaccaaagcttgcattttcaatgtttacacccgtaaatatttcccctgtcttagctacaagaactgcactaactggaaattttgagtacggtacgtatgctttttgactgttttttacagctaattcaattaaatcaatagtctccatccgcctgtgctccattcatgattgccacgcctgatgacgcaccaatacgagacgctcctgcttcgataaaggcaatggcatcttcatacgaacgtgcaccacctgaagccttcactcccatgtcaggacccactgtttttctcattaaggcaacatccgctactgtagcaccgcctgtagaaaatcctgtagatgttttaacatagtccgcaccagcttcttgagataattgacaagctttcactttctcatcatcagtaaggaggcatgcttcgatgataactttgactagtttatcaccacttgctgctacaacagctttaatatcctccaaaaccaaatcgtaatttccagttttcagagcaccgatattgataaccacgtcaatctcatctgctccatttgaaattgcatcttttgtttcgaacgcttttacagcaggtgtgtttgctccgagagggaaaccaataaccgtacaaacttttacatcactatctttcaagctttcagctgctaaagcaacccaagttgggttaacacagacacttgcaaaatcatattcttttgcttctgctaaaattttttcaacctgctcttgtgttgtctcaggtttcaagattgtatggtcaatatatttattcaatttcatagctttctccgtacattaagaaataatctcgatgatttcttttgtttttacactttctttatctattttaacatttttttggaaatttgtaagcatgttttccgaaatattttcattggcataaatcgttgcgatttgttcgcctttagaaacagcttcccccactttcttatggaaaacaatacccgtttcataatctaaattgtcagttttgactgcacgacctgcaccaagtttcattgcaaagagaccaaattccaaagcaggaagtcccacaatatagccatcctcttccgcaagaactggaacttgctgtgtaacctgaactgggcgatataaatcttctaagtcaccaccttgagcacggaccatctcttcaaatttcttcaatgctgcaccattgtcaatatgttgacgtacttcttcaatgcttttctcaacattagcaagccccaacataatttgggctaattcacagataaattcggtaacatcttctcgacctttaccctgtaaaatttcaatagcctctaaaatttccaaacgatttccaatcgaagttccaactggttgagacatgtcagttaaaacagcaactgtcttacgaccaaccgctttcccaagatccaccatagtttgagctagaacccgtgcttcttcaacagtcttcatgaaggcaccttctcccaccgtgacatctagaagaatcgcatccgcacctgcggcaattttcttagacattactgagctggcaatcagcggaataatgtcaacggttgctgtcacgtcacgaagggcatagagtagtttatcagctttgacaagattatctgactgaccaataactgcaacaccagtatcttgaacttgcttgatgaaatctgcttgactaacttcaatctggtatcctttgattgactctaacttatccaaggttccaccagtatgaccaagcccacgaccgctcatctttgcaactggaatatcaaaacttgctaccaatggcgctaagatgagtgtgaccttatctccgacaccacctgtagaatgcttatctaccttgatgcctggaattgcagacaaatcaatctgttcacccgttgcaaccatggacatcgtcaaatcagaaatctcacgcgttgacatccctttaaaataaatcgccatcgctaaggctgacatttgataatccggtactgtcccagctacatatccatcaatcaaccatttgatttcttcagacgatagttctaagccatcacgctttttttgaattaaatcaactgctctcattctttcacactttcaaggatgtagtaacccttatctttctttataatctggcagttgccgaacacctcttccatcttagctttagcactcggtgcgccttgtttcttttgaatgacaatggacaaggttccgtgtgcctctaagcgttgaaaagccccagcaattacttcatgtacaaccgattttccggcccgaataggtggatttgaaacaatatgattaaatgtttcgtccacattctcgtagatatttgattgataaattttagcgataacaccattcctctctgcattttttgtagctaaatccaaagctctgctattaatatcaatcagtgttgtcttggtactaaacaccttagcaagtgtcaaaccaattggtccataaccacagccaacatccaacactgatgcccctttttcaaaataaaggttttttaaaagcacttgactaccataatcaaccatcttcttgctaaaaacacctgcatctgtcatgaaagacattggggtgtctagtaagtttacgtggatttcatgaatatcatgtgctattgtaggatttttttcgtaatacatattggacatgtacttattataacatttcctaaaaacgttttcaagagtttttcttacatgaaaaatatgataaaatgaaatcgatattgaaacgcttacctataggaagaattatgtatgaaaaatgaatttttaaattttgaacaaattgaccgagccacttggcaacaactacatcgtaagactaccattccacttagtcaaagcgaactaaattctattaaaagttttaacgaccgcatccaattacatgaggtttctgacatctatcttcctttggttaatcttatccatatctatcggaaagcacgcaaagacctaaattttacgaagagtttatttctacagaagactatcaagccacaaccatttatcattggcgtttctggaagtgttgctgtcggcaaatcaacaactagtagattgctgcaaattcttatcgctcggacatttaaatacgccaaggttgaattagtaacaacagatggttttctccagccaaatgcggttttagaagaacggcaactgttaaataaaaaggggtttcctgagtcctatgacatggagaaattgattgatttccttgataagataaaaaacggctacgactgccaaatccctgtctattcacatgaaatctatgatattatccccaacaaaactcaggaaattaagtctccagatttcttgattgttgaaggaatcaatgtatttcaaaatccacaaaaccagcgcctctatgtcagtgactattttgacctgtctatatacgttgacgctgatgtggagcatattgaaacctggtacttggagcgattccaaaaattattgacattggcaaaaaatgaccctaacaactattaccatcgttttacccagatgacgtaccctgaaattctatctattgcccagaatacttggaaaaacattaatctagctaacttagaaaaattcattgaaccaaccagaaaccgtgctgatattattcttcataaggccgaaaaccatgagattgataaaatttatctaaaaaaataaatttcacttgtcaaaaatactcttttcagatataatggtgtagttagtacaagaaagggtggaggtgaaaccattggcaaacattaagtcagctatcaaacgcgctgaattgaacgttaaacaaaacgagaaaaactcagcacaaaaatcagctatgcgtactgcaatcaaagcatttgaagctaacccatctgaagagcttttccgtgctgctagttcagcaatcgataaagcagaaactaaaggtttgattcacaaaaacaaagcaagccgcgataaagcacgtcttgcatcaaaacttgcttaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttttcctgttcttgtatatatttcttaattgtggcttcatttagtccaaccgtacttacataatatccctctgcccagaaatgacgattaccaaatttgtatttgagattggcgtgtttatcaaacatcattagagcactcttaccttttaaatatcctataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaggtgtgaagacaatgtggtatttacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataattaaaaaagaaacctttgggtttccttttttttttattttttccatcataaggaggcgggacaaagtggatcagttttccctcgatgagtaacatcattaactcgtcaaccgtaaagccctcactaagattatacacctagtgagggctttatgttcgttttcattattctgtgggtgaggcggagccatcatggatgtctttcccactccctattttttattattagggaagaacacgctcctggagattcaaactaattccttaaaaccaatctgccagttcaaatgtataggtttggtcattataatagtactgatactctcctacatcgcccaaagcctgaaaaatagcattattttcagtagaggccaatgtaatcatttgttgcattgcttctgctgttccgaattgcaagactactttattcgtaccttgtagccgctggtcagtgatggactgtaaaactgcagcttcatcaaagcttgtgaaataaactcccttttgaacatagtaattcaatgaattatctgtacactttggataggtcaatgctctaggttcgtaatattgttcttctccccagtagtcgagtaggtcggtatcagcaattctacttctctctaatatttcatcagggacacatagataatcgtatgaaatatctgtatgcgcttctccacttatagcttgatcaaaaactggatctccccaagtcgtatcgacaccatagtattgtccatttatcttgactagattccaagcatgcccaaactcaccgttttgcccattttttgcaatccctgtgacatagatacaatcaatgcctgcttttttacatagatattggaaggtgcgactatagccagcacaaacggatttcttatctaatagcacactggtaattccttggcttctccacgtgacagagttggtttgtagggcttcaaggtcgtaatccgtttgctttataatcacctcgtaaaaatatttaaccttctcatagtccgaccctgtcggtgcctgagcaagtatcttattcacttcctcttctattttatttcgtgtcggagataaatcagtcggatacactggctcttctaaatccaatatatcaactccgccactcattgctgcttcatcagttagccagtaaaattctggataatcatgagcgacagaaaaatagacgcgcgaatatatttcatcattaacagaatcaatatcgatcacttgcatccgcttgctgagcccattaacaaattggagatagacacgacgttccttatcagtatccaattgttggtagtagaaatttccttgaacctcttcttttaatgctgttaattctgcttctagttgctttttttctttagaaaattcaattttagctgcttccaaacgttcactcagctcttgtcctcctcctgaacaagcagaaaggactgtcgctgataataatatggttaaaacgccacgagaaactttcctcatatttacctacattcttgtttaagtataacataatcaggagacttctgacgaactacacaaaacaaaaagggagtggaaagaattcaatagatcgaaaaagaattcccctcacttccaaacatttaggttcgattttctatggtcactttcttatttttaggtgaccagctgaaacagttccccaaacctttggaggctggagatagagcgaacagagttcgctacaaaactacctgggagacagttggaagttggaaattggaaatagagcgaactttgagaagaaaggctggattttttacccaacctctaatcttgatgaatggttagttatttgggtaaacgtacctcaaaaatagttcctttcggttggttatctctcacagaaatctcaccatctagattcttaataatttgttgagctaaagataaacctaaaccaaatccacctttttgacgtgttctagccttgtcaactcggtaaaagcgatcaaagattttctttttatcgacatcgctgattcccaaaccattgtcaataactgtaaaacaaactagtttgtccttgatattagctgctatttgaattgtcccatcatcatcggtatacttcatagcgttgtcaaacaaaatggtgagcaactgtttaatcaaaaccttgtctgttcgaattggctgatgaatcaaattattaactgttagagtttttccattttcttcggcaatcataaggtaattagcaaagatttcatcaaaatagttgggttggacatcgatcatatcgacttttaagccatcatcacgacgagccaaattgagcaagttcgttgttaatagtcgcatatttcgaacttcttctaaactagatccgatgctttcactactttccaaaatagttgtctcgggatgacgaaatagactttccaggcgattttgaagaactgccaacggtgtgcgtaactcatgactagcattttcaacgaagtctttttgtttttgataactaattaggattggacgcatgctaagattcgataggtaaatacttgctagtatagaaatcaaccaagctgataccataacaatagcaactgtcgattcatagctctcaatggaagatttaatttggctgacattcaccaaaattgtcgcatattttatatcataggacgaataataacctagttcatctgtagccagcccaatcgttatatagcgataatcttcagacataccaaaacttgattcaaccgtagtttccttaatttcacccaatttttccttatctaacggtaggttggccaaaccagtaaaagtatccggattgaccatttctccacttttactatagagtaagacatgagtattgacacctaatctcagctgatctccatctctagtatttttttgttctttaggaacaggcatgctatctgagctagagctcgtcgtttcttcactagttgggctatcttgaagtataaagacagagttgggctcataggttcttgcgatcgcaaaaccaacagccatcgctggttcttccttaatccgtttcaaggtattatctgaattttgatacatagttgaacgcattaattgaaaaatgatagctgtcatcaagccaaaaatcagggtaaatactgcaaaataacggataaagaaggaaaatttatccgtatacactaattttccgattcgcttaggcattttttagaatgtacccgacactacgcagggtttgaagattttccccaaaagtcgttcctttcaactttttcctaattttagaaacatatacctctactactgaaattgtagtatcactgtcaaagccccaaatacggtcaaaaatttgtgtttttggcaaaataacattttgattttgcaagaaataaactagtagatcaaattcttttcctaacagttcaacttcttcgccatttaccatcgtcatatttgtagataggtcaactgtcacatctccaaaggttagtgtgttttcattaaacttacccgctcgttttaatagagcttgaattcgcatcttcaattcttctaaataaaacggttttgtcaaatagtcatcagcccccaattcaaaaccatggcctttatcctctagactttccttggctgttgtaatcagaactggtgtcgtaacccccttttcacgtaactctttcaagacttgaaagccgtctttttcaggtaacattaaatccaaaagaatcaaatcataaacgcctgtttccgcctcataaacgccctcttcaccatcaaaaacctgcataacatccgcaaaatcatctaagaaatcgaaaacagaatttgatagacttaaatcatcttccactaacaatattttaatcatcatacacttccttacgtttcggtttaataaacaaaccaaagacctgggacaggtcacggtctttaagagaaatggttagataaagtactactatgaccatctgaaaaatgaatgataaggtagtctttatctaactatttattgatacgagttcattatatcatggaataagtaaaaatcgaaatctcaatatttattgattagaagaactactatctcctgaaatttgagctttaatttcttgattcctcttttttaaagcattcacttcatcagaagaagtactcgagtttgactgagttgctccacttgtcgcatcaggaggagttataccttgtcccggtgatatatcttgtgtagctcctccctgacctggtagcatgccttgggtagctacttgtccactcttagctacggaaccattttgcgccaaagttacctgactttgtgttgaaactcctgctgagcttttagaaatactcattccccctgcaaagcccaagatagcaactgaaatagcaacagtagctagtactgtttttgactgtgacttaaattgattaataaatgacatgaaattccccttttcaatagaatattatcagaatgagacctgttaaataactcctcttcacctgatgataatagtatagtattgaaaacttaaaacaagctaaagaaattcagcattttttataaaagtccattacacaaaaacatactaagattagtagtgaggaaatctccgacgggagaaagtactcactactttttctttatgataaagtagaggtgtcttgttaagtcgagggtgcttttgacgctagacgtcgcaacaaaaactggcaagacacctgttttagaaagaatgttatcaaagtatgtgggacgccagacgtcgagtattgaaaatgacatcgctaaaacaaggaatcattcaagacaaagaggtaatatcatgcgagtagtttttgggattgatgtgagtaaggcaagttcagaagtggccattctagtcaatggtgagaaagttcatggctataccatatccaatgacgccatcggctttgctcggctacttggcgatttgagaaccgtccataagccagaaatcatctttgaagcaacaggtgtctattctcgccgtctccaaacttttctagatgataatggctatgcttatacacggcttaatcccttagaagctaagaagcaactggatagcttgcgtgtgcggaaaacagatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacaaggtcttacaggtcactttccctgaattggaaaatatcttatcgacaccatctggcgaacaatactggaacttagttatagcttttccttgtaaggactgcgtacttgagttaagcaatgatgaactctcaaagagcatccgtctgtccacttcaaaacggatttctgacaagcgtgtggcttacttagccgagaagcttatagcactagctaatcaatcttattgtgccgtcaagaaaacctctccaatactggaagaggtccgttactatacaaaagaattgcttagactttctgaacagagacaggcagtcttagacgaaatggtggaactagctcagccattacctgaatatgacattctgctctctattcctggaatagctgagactactgcaacaagtattattggtgaactgggagatattcgccgttttcagtctgccaatcaaatcaatgcctttatcggtattgacctgagacactatgaatctggtaacttcctcgctaaggaacacattaccaagcgtggtaatccctacgctagaaagattctgttcaagtgtatccacaatatcgcttcagccaatcataccaatccttgccatatcgcagacttttataagaaacgaaaaagacaatcgcaaacgacttcaacgaagctgcacacgattgcctccatacatcgtctcattcggacaatgtattacctcattatgcataacaaattttacgattacgcttcaacccaaaatcggtaaaactgtttatgctctatcattgtaacaccttatcaaaaaatttcaacataaggtgttggttttgtatgcactttttacacgtaactttagtccaaaataaaacaatttccttatttggatgacgagacacaaaatatttttcgtcaaataccttgatgaacttgacaaatggtagaaaagaagccctctcggacttctgaattacaactctgtaatatcacctgtgcgtagataaacaacccactcacaaatatttttagcataatcaccgacacgttccaagtaggttaaaacttggtaatagtcgcgaccagcaaccaaggattctggattcttcttgatttcttccgttgtcaattcttgaatagttgaatagaattcattgacaacctcatcacgtgctgctacttcataagcgcgctccatatcagcatcacctaagtagagttccaaagtttcttctactaattgacgaacttcacgtcccattttcttgatttcttcttcaacaactgggatgcgaacttctcccttcatacggatagctgctttagcaactgagactgcatggtctcccatacgctccaaatcactagttgcttttaagactgtgataacgcgacgaagatctgttgagacaggttgttggagagcaatgatttcaagtgattttttctctaatttcacttcgaaagcattaattttcttatctgcttcaataacttcttttgctaattcacgatcatgaattgtaaaggcacgaacagcattattaatctgagccaatacttcatttcccatggcgtaaaattggttatgaagttttcctaattcctcttcaaattgagctcttaacatgtgaacctctttctttttcttataggccttagccgaacttacctgtaatatagtcttctgtttctttattggcaggattcaagaacatttcttttgtcaaattgtattctatcaaatcgccatcaaggaagaaacctgttcgatctgaaatacgtgatgcctgttgcatagaacgtgttactagcaccattgtatacttatctttcagaccataaagtgtgtcctcaattttaccagctgagatcgggtcaagggctgaagttggctcatccaacaaaataattttggggcttgttgccaatacacgggccacacatacacgttgctgctgaccacctgaaagtccaactgctgagtcatgcaagcgatctttcacttcattccaaatagaagcaccaatcaaggaacgctcaactgcttcgtccaagacctgcttgtccttgataccgttaatacgtaaaccataaacgacattctcgtagatagacatcgggaatgggtttggttgttggaataccataccgatttccttacgaagatcaacagtatccgtacgaggactgtatatgttctttccgttgtaatcaatcgcacctgtcaatgttacctctgggtttaaatctcccatacggttaatagaacgcaagagggttgacttaccagaaccagagggtccaatcaaagcagtaatttcatttggatagaaatcgattgacacattattcaaggcttttttcttgttatagtaaacagacaaatcttttacttgtaaaataggtgatgtcatttgtttcctttctatccaaaatgtcctgaaacgtagtcactagttgacttgagttttgcattctggaagacatttgctgtcttatcatattcaatcaagtcacccagatagaagaaagctgtgtaatcacttgcacgagctgcttgttgcatattgtgcgtaacaatgataatggtgtagtccttcttcaattcaaacatagtttcttctaactgcatagtcgcaattggatccaaggctgatgcaggctcatccataagcaagatttgtggttttacagagatagctcgtgcaatacacaaacgctgttgctgtccacctgataaggtaaaggctgacttgtgcaagtcatcttttacctgatcccaaagggctgcttgtttcagagaagtttcaacaatctcatccaaaacctgcttatctttcacacctgcacgttcatgtgcgaatgtgatgttgcgataaatcgattttgcaaatgggttgggacgttggaataccattccgatatgcttacgaatttcgtaaacgttcatatctggtctattgatgtcgattccttcataaagaatttgaccggttaccttagcaatatcaatagtatcattcatacgattaagactgcgaagataggttgatttcccacaccctgatggtccaatcaaggctgtaattttatttttttcgaactgcatatcaatgcccttgattgcttcatttttaccatagtaaacatgaacatcttttgtcgaaagggcgatattctcctctggaaaagtaatgatatggcgttcattccagttgtaatctgccattttttctccttataagtcagacttctaggctgctgaagtcagtttcgcatgaagtttcttaccaatataacgtgcagaaaggttgaaaatcaagatgaagaccaagagaatcgctgctgaaccagcagaaacttgggttgcatctggaattgtaccttcgctgtttaccttccagatatgaaccgcaagggtttctgattgacggaagatagaaatcggactagtaacactcaatggattccagtttgaccagtcaagagctggagctgactgaccagccgtgtagataagagctgctgcctcaccgaagatacgaccagatgccaagacgatacctgttacaatccctggaagtgcttctggaataacaacatggagaacagtttcccaacgtgatagaccaagagccaatcctgcttcacgttgtgtatggtgaacgtgacgaaggctgtcctctacgttacgtgtcatctgtggtaagttgaagactgtaagagccaaggcacctgataagatagaaaaaccgtactcaaactgaacaacgaaaatcaagtaaccaaacaaaccaacgacaacggaaggtagggatgacaaaatctcaatacaggtacggataaagttagtcaatggaccttttttagcatattcagccaaataaatacctgcaccggttgacaagggaacagaaattaagagcgttacaaccaataggaagaatgagttgtagagctgaattccaataccaccaccagctttgtaagacgaagatttacttgtcaaaaaatcccagcttacatgtggcagaccacgtagcaagatgtaaagaatcagtgacgtcaagataacgacaatcacaccagcgattgagtaaagaataccagtcgccaatttatcaaattttttagcgtgcatagtttttcttaccctctctcgtaataaatttcataatcatgttaaagataaggctcatcaagagcaagactagggccaaggaccataggacgttgttctgaacagttcccataactgtattaccgatacccattgtcaaaacagaagtcaaagtcgctgctggcgttgtcaaggaagtcgggataaccgcagagttccccactaccatctgaatagccaaggcttcaccaaaggcacgcgccataccaaagataacggccgtaaaaatacctggcttagccgcgttcaaaataacacgccaaatcgtctgccaacgagtggctcccatagccaaacttgcttcgcggtagtgacgaggtactgcacgtaaactgtcaaccgtcataaaggttactgttggcaaaatcataacgaaaagtacaaatacacccgacaagataccgaaacctgttccaccgaagattgaacgtacaaatggcacaactacttgcaaaccaatgaaaccgtatacaaccgatggaataccaaccaaaagttcgataacaggttgtaagatttttgcaccacgttttggtgatatttctgtcatgaagaccgctgcaccgattgcgataggggtcgcaacaacagctgacagaatcgtaacaatgaaagaacctgaaatcattggcagggcaccaaatattttcgagcttggttcccacttgcttccaaataagaaatcagtgatgctcacaccgtcaacaaagaaagtcgataatccacgctgtgcaacgaaaatcaaaatcattgcaacaataaagacaatcaatgatagacaaaggaatgtaattaccttaccaaacttctctaatcgagaatttttagatggagacgataactcttttgctagttgttcgtttttcatgcttactccttctcagtcaccgtgccatcagcacttttcacaactttcatatcgttgatagaaatgtatcccatactttcaacgataccattttgaacttcatctgacatcatgtaatctaaaaattcttctgtcaaatcagtcgcttttcccatcgtatacatatgctcataggaccaaattggccaatcatttgttgctacattttcagcagttggttcaaaaccgtttaacttaattgttttaacggaatcatctagataagcaaatgataggtaggaaattgcacctggtgtctgagcaacaatagattttaccataccgttagaatcttgttcttgactctgagttgcggtttgtccatccatgataacactatcaaaggtcgcacgtgaacctgaactagctgcacggttaatgattgaaatttccaaatccttaccgcccagctctttccagttggtaatctcacctgtaaaaattttacgcagatcttctgtagtaatatctttaaccgatacctgctcatttacaataacggccaaaccagctactgctacttgatggtcaacaagtttacttgcatcaataccatctttttcctcagcaaatacgtcagagttaccaatctgaacagctccagactgaacttgtgacaagccagtacctgaccctcccccctgaacgttgatggatttaccgatattgacactaccaaattcatctgccgctgcctcaacaagtggttgaagcgccgtcgaacctacggctgtaatagactctcctcgatcgatccaagaagaacaaccagaaagagccatactactcaaaagaaacaaagctgcaattccaagcttctgcttttttttcatttcattttttcctttacatttttcagtggaatctcctaaaattaactctgtattttacatagaatttacaagatatttccactcatccactatatcatataaaaagacaagttgcaaaaaaaatttgctgatttattttaaaatctcaacccttttggaaagccgtttttaagcgttccagatacaatttttgcgaaactaagaccgttcccctggactgctacctgataccagccattagctaaatccttggacacagctatggtatgtcctgcagtataggacgagaattcttctaagctgatttccactcgattttcaacctccgaactatggagtgctagacctaaagcaaaacttggttcaaatctttttttcttatacgtccccaagtgaagaccatttcgagcaatctttacttttgacaaatcaggaaggccgtgtggcagtaggtagagattgtcgccaaaaacctgcagtaaaccatccaattgaacccttaaatgcttctgttcaaattctttccagagagattgttgttctctattcaaattagattttcctggttttaattttttctgactggcttcccctagaaatctaaatttggcaacgaactgaccttctcctgcaaaatggtggggatacatacgagcaacttctgtatatccgattccttctaccattccattgattttaggaatgtctattagttccaaatcatactgttctaagagccaagtcactacttcttcattttcctctggtgaccaagtgcaagtagaataaatcaattgaccatctggagccaacatgttcaaggccgattctaaaatttcacgctgtaagcttgcacattgtgctggataatgtttggaccaatattgaatcgcatcggggtattttcgaaacatcccttcacctgaacagggagcgtctaggacaatcatatcgaaatatcctggaaagaccttttccaagcggtctgctgattcatttgttacaacaacattcctcgctccgaaacgctcaatattttcagccaatatccttgctcgtttgttagaaatttcattactaaccaagagccccgtattttctaagtatgaaagcaagtgagtagactttcctcctggcgctgctgccaagtccaatactttcatcccttttttcggtgctgcaatctgacctacaacctgtgcagctggctcttgtgagtagactaagccagttacatgttctggagatttccctgagaccttaccatagtatgaccaagtcatattagggattggttgctcaaagtccaattggctttctttaagaggatttgtgcgaaatcctgagattgggtcttgttcaaaactctcaaaaaatgcttgggcttcactaccaagcaaatgattatatttatctataaaatcctgtggtaattgcattagaatatataccccttcacttcctcaagatgggattctgatactagcatgacaaactctcgcttatcataggccagactcggaccctcaaaacttaacatgactaagcctaaagaggaaccaataatactggctgctgcgtagtcccatggacacagataagaagcataggcaaataatcttccttccagaacgtgggcgaaaccaattccagcacttcctacagatcttgtacctaaactttgatttgctaattctgccactccatgtgcattgcctgcgtacaactttgcattgattcctatcaaactctggcgaagagggcgcagctctggtttctttaagcgttcttgattgcaaaaaacagggaatgaatctcctccatggaaaagtttgtctcgcatgacatcatagatgataccgaactttcctactccattttcaaaataggcaatcataatggcaaaatcagttttctgagcaataaaatttgtggtgccatcaattggatcaataacccaaacatttccctcatgaatagaagaaacgtccccaccttcctcgcctaaaatcccatcaccttgatagcgagattgaatctgttgagtcaacatttcttgcacttgtttatcaaggtgtgttaccaagtctgtaaagtcacctttttcttcaatctgaagatcatcatgtaaatgctgtcggagaaaatttccagcttccaggacaatcgtttgggcaaagtgatacttagtttccaaaacaaataactcctttccctttatctcgagcagccttaacaactcgataggttgaataaccagaaactgcttcaaagtcacgatcaatttgacgttcctgtcccttacttttaacaacatctttgaagcttttataactagctaatatagctaccgcatctgctcctttttcataagctgcctccacctgattcaaaaaagaaagcacggaggaaatctcctctgtgctccacgaaaaatcaagtggatatgaataatttttgttcatatcttttatctttcttatcctatttctgctctcaatgtagcattttttagttcttgtttgcgatacttccgcggaagaaatgcacgaatttcatcttcgttaaaaccaatctgcatccgcttctcatccaaaataatcggacgccgtaagagactcggataggtttcgattaacccaataagctgcttcacagaaagctcatcaacatcaatatctagtttctgaaaaacttttgaacgggtagaaatcaagtcatctgtcccattttctgtcaatgctaaaatgttctttaattcctcagcagttagagggctagtcataatattgtgctcaataaaagggacttcgtgacttgtcagccaagcacgagctttacgacaactggtacaactcggtgacaaaaataaagtaatcatgtcttccatcccctctaaaaacatttttcttcttattattatactctaacttaaaagagttttcaatagtaaatctaatctcttccctgtaattcacctaattttcctaaagattctatttttttctctaagcgtaataatgtttcgttttgttcatcaatttttgccatcaagatatccaacttcgtttctcgctctgtttcagagaaaaaacgagttattgtggaggtaaccataccaaaagtacaaataccaaccaacatcaagaggatggctataattttagaaatcgtatcttgggggacaatatctccataccctacagttgtcatcgttacaatggaccaccaaagtgcatcgaagaatgattttccttcaattactgataataagacacttgaaactagcactgctgagatatttaacatcaacactttggataaactgttggtatgcaaaagcttgttgattgtatcccagaatcgattagacagggcaaatattctcgttactttgaccaatctgaagagtcgtgcaagtcttcccaagcgaagaaaactgaagaatgaatcaaatggaataatggcaattaattccaagatatgtccctgtacatattcaagtatgtcatccgcataataaagctgagcaaaataatcgcaaacaaaaataaaccataagagcaagtctagtacccgatacccactagaattggcaatactagcatccattaattcaagtacgataagaaatacatagactacagctatgtaggtcatagccttctcataaaaaggatgacgaatcaatcgtttaagcatatttcccccattgcaaggcaaatttctcatcagatttcatctgctccatcaatccttcaattccatcaaatttgaccatatctcgaattttttcaagccaaaaaatagttattttttctccgtagataaagcggtgaaacccaaaaatatgggcttctatccgcatctccgttccatcaaaggtcacatttttcccaacgcttgtcatagctcgatagcgttttccatctacttcgacatcagcgacgtagactccctcagatggtaaatggacacggtcaaaaggagccagatttgcagtcggatagccgatggtgcgtcctctggcatctccatgcaccacaattccctccgtcataaatggataacctaaaagttgattagctagagagacatcccctgactggatagcctgacgaatacgagttgacgaaactttctctccgcccaggctcacttcacttacaatttctacctgaccatcaaataactctgtcaaatctttgacatctgctctgcaatttccaaaatgatagtcgaaacctgcaaccaaaatctgggcattgagacctttaatatagcgctccataaactgctgaggagtattattagcaaattcactagtaaaatcagtcaaaataagattatcaacaccatattttttcaataagaggtagcgctgctcttgactagtcaaatgcagtaaaagttctgggctaaagcgagaaaaagccaatcgaggtgactctggaaaggtcagaacagttactgtcaaaccttgctcatctgctacttttcttgctcgatcaagtaaagctttgtgcccaagatgaagcccatcaaagtagcccagtactaaaaccgtcggctcctcttgattcaattcactataatgtttaattgttctaatgttcatgttttctattttatcacagttattgagaaatttcttagaccaaaaccttgctcggtttatacagctggtcgcgtttttcaaaaatagcaatcaactgaccatcatgaaagcctgctaagcgctctgcttctgcattcaattcgacaaatcgaccaaatgtagcatcttgcacctgctcttctttcaattctacaacaggtaaatccccgataccacgttcaataggttggaggaatgaaaaatcattttcagctaccagcgaagaaatttcttctaaagtcaaggcatccgctaggtccattccagctgatcctgttcgttccaacttggacatatggctggcatagcccaacttagcccctaggtcaacagacagggtgcggacataggtgcccttaccacagcgaactcggaaggtaaaccgtgcacagtcatctgctagttcaatcgggctagtccgttcaaaactgtaaatctcaatttggcgttgaggacgttcaacttcttcgcccgcccgtgcgtattcgtagagtttacggcccttgaccttgacagcagagtacataggcggaatctgggtaatagtgcctacgaaactggtcatagcctcatcaactgcctgctctgctatgtacaaaaccggtgtccgctcaacaagatcgccagatgcatcttctgtcgtggtagagtaaccaatggtaatctccccctcgtaaatcttgccctcttcctgcatgtactcaatcatgcgcgtggccttgccgactgcaatgggcagaacacctgtcacatatggatccaaggtcccaccgtgaccaatcttcttctcctgcaaaatcttgcggagcttaaaaacaacatcatgcgaggtcatacctgcctctttttttacattaataattcctgagatcatgttctcattataacacaaaggaccgctcttgtgggcggtccggtatcaatcagtcatcgtagaaacgatagctaccgaatgttgtacctatcaaattctctagttccttatgaatacgtcgcatggttccagaaggtgctgcttcatatgcaactgcctcatcaatgctttcctcagcctcctcatcatagccccaagaaaatatcaatggggcatcataatagccttcgtcaccaatttttatggtcggccaatccaacagcttgatttcctttcaaaaattctctaaatttttttgccttgctgatacgaatagaagtgtaatctactgaattctcaactcgattatctgcacctatatattcaatcatatactcctgctccctaagactgaccgcaacatctacgctctttccttcaatataataagccttaaaaagaataaagtcaatattctcgtatgtacgttcaaattgtttcatgttctttcctttcaaaaatgactaaactagatatcccgatgaaaatcgctatcaatctcaaaaaatggttgaatatcctgaacatactccaaaacgccttgaaactctccttggtcatcacgcaccgccttatagactacatagacaaacttgcccatgctctcggacttgaaccacatggcgtccaatctggcttggtgttcgtttgaaaatcatgtcttcgacagggtggctgtcattgtaatattggaaaatgtcatccttgttgacaaaggttaattccagcggtaaatgattgaggataagattcgcttgctcaacagataaataaccattgccgaaggtctgcggactagttctgtcctgaacagtttctgacttttccttgggtgtgaaggcaatggtaaactggccttctggcgtgtcgataatctgctgatttggtcctgctggctgcagagaaacagcatttacttcctgctctgctatttcccaaaaagcctcccgatgaggtacccacttggctgtcggcttgacaatggcgtagccgtaggcgtcactgtctactgccacttggagccagtcgtcctgggtgaaaatctccagcaaaatcatgagaagtatggcttcttccttgaaaatcatctcctcgaactccttggcgaagttttcaaagtgagcacgtgtcgcagctaggtcacctccttcaagtgccttacgggccgtcttgaagagatcgcgaatctcgtcgtccacaccccacatgaccttgggcggtgcatcataaccgtaccgctccataatgggaaagaagaccttttccttgcgggtatagtggttttcaaattgaccgaggaggccaaactggcgtgtcaaaccttgcaggagctggtctttcagctccgcatcctctgtctgctcatactggtcaatgatacggcggatgcgtaagagagctgcccgcagggcaaggttttcctgcttaaagacatagacagggtgtccttcccggtccatatccgccacatccacatccgcaatggctcctttgaagaggttggcgtggatattgcagaggctcatgacatcttcaaaagtgatacccgtatcgctggacatgagttcatgctccatcatggagatttccaaggcagaaactcccgtgaaatgctgattaaactggtcctgaacagactctggactggccccattgtgcaggtccaagagaatattcttcagaatgtcaacacgtttttcggtcatgcttctcctcctattacctcgtagccgttgcattccaagacctgttgaatacggtctagtggaatcttggtcatcttagatcctgtcttcagactggttaccttaccaactgtgttcagcatagctggatttgccaagggcttgaaaccaagctctaccagaatgtccttgacttctgggtgctggttgataatctctgcaacaggcagatttaggtcgatggtgttcattttacttttcctctataatttttttgtaaaatacaaggccaattcatcatcgttataggctttggcacctactggcaaagagcaccctcggtaccagacaccgcttccgtctggtatgaaaccatgttttacatagagccgttgagcctttccataatttgcattcaaaccaactccaatacctactgtatccgtaaattctgaggcaagttggcagatagcatctaatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactataattgccaacctatcccctgattttgaaagtcttcaaaaacattgaaatcagcaatttcaggtattccagattggtaaaactgtccctccttcacttgcttaatcaaggtgatataacctttacaaacccccgtttcttcagcaactaggacgatacgttctcccttttcttgttcccttaaatagttggttaaaatctctttgcgggagggccaaccttgcttctggaaggcctcatcaagttgaagtatatgctcaaattgtaacggaacaatcatctcaatcctccctcaacgcctcaaacttggctttcatggttgggttattgcgggttagttttttgacggagacatcgtctagtttattattagctaggcgaagctggttttcgctggtggtcagggctgctttgacagcctccattcgcttgattgccttgtcgatttcatcaatagctttttggaaattgttgctggccgattgatagtttttggcaaaagcattcttgaaaatttccaaatcttcttcaaaatgagtaatatcaatattctgctccttaaccaaggctaactcctgctgatattgcagactattgagcgcagcatttcgtaaaattccgattaattggataaagaactgtggtcgaataacatacatcttctcatattcatgactaacatccacaatccctatattgtaatagtcattgtccgcctctagcatgctgactaatacagcatattcgcattttttctcccgacggtccttatccaactccttaaagaaatcagcgtttttatgcttggtcttggtcgtatctgcctcgtttttcatttcgaacatgatggaaataaattccaagcccgactcgtcaaaatcacggaagatgaaatctccttttgaaccggacgctgatacttcgttgtccttagcaaatttggcacgtggaaaagcataggaacgaaccttgttaaactccgcctcagcaaattgctccaagctctctccaattgccttagtagactgctgagccttgaaatttttgtaaaattccacctgctcatccgccgccttgagccgtacttcgtactcctgacgagtggtcgccagggctaactcttgcttttgttcctgcaaaaccaaagcattttgtgccgcatccctctctttttccacctgagctaccgcctgctgcaactccaagtccttggcgagaccgatttgccccaactgagccttaagctcttggatttcttggtctttttgggaaatagcagagctgatttccagttccgtctgactagcaaatttatcaagttttgcggtcagttccagaatctccttatccttatcactcaatctagcctgcaaatcattttcagccttctggcttaataattcccgttcccgctccaaacggtcgtagatttccttatcaaactccgcaccacgcacctgggctaaaagctgactatattctgtttcattgacctgaaaggccgtcccacaatgggggcaagtaatttgatgcatatactctcactttcttcttttcaaataagatattaatttatgtaaaaccgtagctactcccagcgccaataaaaaataaaagaaacgaaccgcatttctagcatctggaagtgatagagcccaaaggacaaaaatcgttatggcagtcggccatctccagccccaggtcatcttccgtttgataaaccattccatccaatcttcattagaatcaaaccgtgtttcataatattcttctttcagttgttcccaccactttttcataacagcctcctttcagatcacagaccttctaattcaagctccagaaaagtcctccacttttcctgcaagggttgacacacaggcggctcctgaccttctaagaattttttgatacattcattttgcaccaaccagcctgtcatgtctttttgagcattcgcaaattcattaccaaaatcttctggaattcgttcttcaaaagtaatcaaggtctgattttctagctgagacagtgcaaatgaaactgttgctgaatcccacctgtaggcaattttctcattttttcggtattccagtaaatccataacttcacgaaatccttccatttcaaaaaccagcgtatttcctacaatgttcaactgtggaaaccagtgggcaaaaccactgtctgtcgccaacaaatcccaggactccgccaaactagccgacacagaatagcaaatgctgaacaggtagtgccccgcctctttcttcacactaatcttcatatcatgctcctattctatccttctattaattataccaaaaaacaccggtctataaccgatatttccattgtctctattctttaagcatgaatgctattcattccagaggatcgaaaaacggtatcttgaaatctgaattattttttataacatctttcatagactgtccttacctttgtttatctggctcatactccatgttttgtatcccctagcaatgttagactttcctgccacataatggacattgtcatttttgaaacacttctatatttcattcgtcacctaatttattttaacatatagaacagagtttagtatttcaatcattcctttctcattttatgctatactagatgtattgaaaacaaggaggtttatatgataaaactaatcgctcttgatatggacggaacccttttaaacgagaaaaaagagctgatgcagccacagattgatgccattcatcaggctgttgaagcgggcttcaagattgttctttgtactggtcggcccttggctggtgttaaacctttcgtagagcagctcggctttgacaccgaggaagaatttatcattgtcaataacggctgttcaacccattcgacaaaggattggagcctgattgactgggaagaactatctatctctgatattgattatctttccacttttattgaaaatgctgatgtgcaaatctctctttttgatgaggaagactacttcgttcttgcagaaaaagccaatgcacgcgttaatttagacgcaggtttggtaggaatgactcctcaaccaattgatttaaaagaagcccagtcaggtcagtatcgcttctttgaagccatgtttgtcggtgaaaaagtgcatattgatgcctttgaaaatcaacacaatcctgtactcagcaaacgctattccaccgttcgttcacaggactatctcttggaaattttaccaaacggtgccagcaaggcctctggtttaaaaaaattggcagaccgcctcggtatcctcccagaagaaatcatggctatgggagatgccaacaacgacctggaaatgattgaatttgctggacttggtattgccatgggaaatgccaacgagcaggtcaaggctatcgcccaggacatcacagacaccaatgaaaacaacggcgttgccaaggccattgaaaaacacattttgaacaaataaggagacaatatgaaatacccaacactcttagaccgtttcttggtctatgtcaaagaaaatactcgctcagatgaaaattcgacaaccactccttctacccaaaaccaagtcgagtttgcacagaatatccttctgcctgaaatggaacggattggtttgcagaatgtccactacctaccaaacggttttgcagtgggaacactgcctgccaacgacccaagtttgacccgcaagattggcttcatcgcccacatggatacggctgatttcaacgcagaaggtgtgaatcctcagattatcgaaaactacgacggtaacccaattgccttgggaacttctggctatgaattgcatccaaaagacttcccacaacttgccaactaccacggtcaaatcctgattaccacagacggtactaccttgctaggctctgatgacaaatcaggaattgcagaaatcatgacagctattgaattcctaatccaaaaccccgacatcaaacactgcgaaatccgtgtcggctttggtcctgacgaagaaatcggtgtcggagcagacaagtttgatgtgaaagacttcgatgtggactttgcctacactatggacggtggaccgctgggcgaactccagtacgaaaccttctcagcagcaggtgcaaagattgatttcctaggacgcaatgtccacccaggatctgctaaggaccagatgatcaatgccttccaaatggctattgatttccacaatgcccttccagaaacagaccgccctgaaaaaaccgaaggatatgaaggtttcttccacttgatgaacatggagggcagcgttgatactgcttctaccacctatatcatccgcgactttgaggaagaagatttccaagcccgcaagcaactcatgctggacatcgctgaaaagatgaatgccaactttgacactccacgcgtcattgtcaacctacatgaccagtactacaacatgaagaaaatcatcgaaaaagatatgactccaattaacattgctaaggacgttatggaaaatctaggcatcaagccactgattgagcctgttcgcggaggaacagacggctctaagatttccttcatgggcattccaacaccaaatatcttcgcaggtggcgaaaacatgcacggtcgcttcgagttcgtcagcttagaaaccatggaaaaagccgtcgatgtcatccttggaatcgtcgcttacaaataaaatttcaaacggctttcaatagaaagtcgtttttttctgaaaaaattttaaaaaaatgccattttatgttgtgttattgaactaatactagtataatagaactataaaaaagaaatggagttttattatgacagaagaaacattagcacagggaattctcattggcatttggggtacaacactactattttcatttatttggtatattcttgttgctatttccaactacatcctcttcaaaaaagcaggctacgctggttggaaatcattgattccaatctacaatctctatatccaacaatgcatcaccttcggctatgaaaaaagatggttcattctattcttactaattccactagcaggaccattatatggcatctatctcgtttacaattttggtcgtagcttcggtttatcagctgtacaagctatcttctatgttcttcttacacctatctttaacctctacatcgcctttaatgatggaagtcgttaccaaggtccacaagaattctttattgattaatatacaatcaagcccccgcacacgcggaggcttttttaaacgaatagaaaaataagaagaaccatcatgactaggctgaccaaaatagataaggagttaacgttggcaggttcagctgagcgactacctaactttaatgcataaattggggacatgactgaaatcggagaaactagacagaccagcaacatgattttcatcgttttatcaataggtagaagaaaataaatgactcctgctattagaatattcgcacccagcctcaaagagagaagataggccaatcgactaatttcttgccaattcaattttaaatcaagcaagattcccaacatgagcatggctaaaaaaggattggcgttactggctatcgtcagcgcagagataagttcgcgtggaagtttgatagagcagactgctaacgataggctaactagatagactactagtggaactgagcgtgaaagattctttataaaagttgcaacggtcattctttcctgctcttcatccacaccagctgcgatactgtaattcccacctagaaccatgattgcattccccgcatcaaatacgatgacacttagtagactagatagcggaaaaaaagcttgcacaaatgggagtgtaaaggttccaatattatagcctgataactgcataagaccgacggaagtctgttgaccagacttctttgcttcccagtatcctaccatatccaaaaaaagattacaaagaatccctaatatgaagggaaggtataaatctatagatacttgggttgtcgctgaagctacaaggagagaagctggtagcgtaacattcatcactaagctagaaaagattcttgcatcttcccttcgaacaatccctttgacttttaatgtataacctaaaccgataacaaagataaaaccgagagcacgggctaataattcaagttcattcatgaaactagtatagcatatagaaaagaattttgatgatatataaaaattttatataatcgcttgattttgctaaacaataggtatataatttatatataaaataattacataaagataaagaggtgagtttatgtactaccccgtatcctctatcttgatagaatttctggtcttagccatcgtggaaaagcaggattcctacggctatgaaatcagtcaaaccatcaagatagttgctgatataaaggaatccacactctaccctattttgaaaaaattggaaaaggcgggctacgtcaccacctatacccaagaatttcaagggagaaagagaaaatactacaccatcacacctgctggacgtgagcacatccccttcctgcaaggtgaatggaatagctacaaagaccatattgacggaattatagaagggagcttacgaaaatgacacgcgcagattatttgaaccaactggaacaagcattatttcaacttcatccaagtgccagacaggaggctttagactacttcaatgaatattttgacgaaaaggataacgacgaggaagctattatagagctaggaacacctgatgaagcagcaaaggaaatcattgccaatctacctgaagatgccctaatcaccgagcaagaccaagcaagtccacattcatctaaaccatttgatttcaactttgattttgattttcaatttgactgggagaattttttcaacaattttaaacattcagcctatcaagctagggaaagaattaaattgacggcgaagattgaagaattacctgagttttcaaatctacagatttcgctcgaagatcaggctcttagcgttcaaagttataacggagaagctgtcttattgcacaatcctgtttcagaagatggtagctaccaggcttttgactatcaactggttcaggatagtttgtacctaacaagcaagcctacccctaatcacctctacttctcaaacaatcaaaccagctctgctattctcaaaatccctaaaaaactactgccccttactagtctcaatctgaaaacgacagatagtagtctgacgatggcggctgtgcaagcgagcgaacagctagtcatcaatgcaaaagatagcagtatcagcatgacgaaagtgagctgcccaagctctgctctacggttagaagactctacactaactatctcagatggacagatgagcgagttaaaattggaagccagcgatgctgttatcactctctcaagcatgagcctttcagatgcaaggataacattagaagactgtgtctggaagttgaaggattttgttattgaaaagagccttaactgccaggctgaagattctgtcttaacctataaaccaagtacggacatcagtttagacatctgggaggaagattctagccttaaacttccaaaggataaggcgtttacaatgatgaaagagggtgacatcactcatctcagctacaagcaagaaaatagccctgctcagctagttattcattgtcaagactgccagcttagtgtgggataaaggaggtttccatgaatcgcaaggaatatttacagaaactcgaaaaatatctcaaaaacctaccaaaagaagattttcaagataccttggactatttcaatgaatattttgacgaaaaggaaaacgatgagcaagctattcaagagctaggcagtccaaaagaagccgcccatgaaatcctagccaatctctatgataaagagaagactgaggataagccaaatacccgcaatatggtctggctgaccatcctctctatccttgccgccccaatcggcgtccccctagcaatcaccttggtcgccctcttcatcacccttctcctaatcatctttagcctctttctgctccttatctcactctggattgtcctcctcagtctagcaatcgcccagctactcctcgcctttgacctcttcacactatcatggtctacctccctcctcttcacaggcctggccctcatctgcttggccctcactctattgggtagtaaattcactctagaccttggaagcaaaaccttcttgcttgttttacattggatacaaagaaagattcgcaaaggaggctattatgaaacagcttaaaccatttacgaaaatcagtctgagcctgttcactcttggaacaattctcagtctcattggctacctggctggcggttggacaaatatgaaaactgttgcagaaaactattttcagccccaaacggcaagctttacggatattcgttctatagaggtcaatgaaaaactgtccattatgccctcgcctgacaaacaatttcacctccactattaccgaaatcagcacaaaggcattgacctcctcagccaccaagttcaagatggaaaattaaccatttctagtgcctatcaaggcatcgttacttatgatggtttactcgaacctatcttaaatcttgtcaatgaccagaatgttgcctactaccaacctgtcttacaggtccctaaaaatagcacaatcgaaacactctcagggagcattcaaggagatgtctatctggataaagtgactattcaagatttccaactctttgttgaaaatggtgacatgttgattgaaaacagtcaactcagctttgctcatttgtcacacctcaatggagaagtagcaatcaatcattccacattaataagtccgaaagacatttccgatactgtcggcagtagcttaacgattgaggatggggattttaaagctgaaaacctaaaactagaaggaagacatagtatcagtaattacggtggttcaatcgacatttctcttcattccaaaacaaaaactgacatccatatagatgccagtcaaaataatctgggaattgaccttccaacctattccaatccccaatccactaattacctcaacatctctacactagatggtgaattgagcattcggtaatcgctaaaaagccctcctcacggaaggcttttctatttatttaaacaacaaaatagagatcaatgccaagatagctggtccaccttgggttaagataatttttggacttgctgtaatagcaccataagctgctgcagcaataacacatagaacaaaaatgcttgtaatttctaaattaccagtaaaaataccgtagaacaagaagaccgccaacaagccattataaattccttgattcttgaacaatgcagtcacagacttacgttgtaattcttccttctccatattgaatacgcgactagtagagtctgaatgggtcgcaaaggtttccaaatacatgatatataggtgctcaatagctacgatactagctagaatagtggtaaaaatagacataatgtctcctctcaaaaaattatataggtagattttgcaagccaatcaatagtttatcaagagtggctaggaattgctcgctctcctcaacagttagaatctgattcatcgaagctttgatagcttggtggtgggcagaaggattcgtgattagcgcttctctagcctgctcagttggccagacaagtacttctctctgattgtcaggatttcgcttgcgaatgatatagccactctcctccaacaatttgagatgacgcgtaaccgctgcgcggtctatctgaagccgctcctgcaaagccaactgatgcaggggtgcatcttttagtaatgtttgcaatattgaatagcgtgtcaaactgattcccaactgcttttcaaaaagattggaaatcgtctcatctgtcactttcaatctgtataacaaatcttccatttcttgcattatctacctcttttgattgattaatcaatcattgatgagtcaattatactacaatccgaacaattttcaactattttgcctatctattaaaaaaatatgttgcctacacctatattttgttataattaaggaaataactagcagagggatgggacttacttatggaaaacactcctagactaaacttggtcatagacgtgctcatgctcgctggtgccattttggcacaaagcggtgcagaaattcaccgagttgaagataccatgattcggattgcacattcacaaggaattgaacaggccaatgtccttgccatccctgctgctatctttttctccatcgaccatacgaatatttcgcgtatgaaacgcattgtcaattcaaattacgacatgcagaaagtttgtgacgtcaaccaaatctcccgttccctagccaatgaagaaatcagcctagaagaagcatggagccaattaaatgcaatcaaacaacaaaagccaccttataacaatatccaaataaccttagctgccgtagtagccgcaccattttttaccatcatgttcggaggttctcttttagatgcagcaggtgctgtcctcgcaacagctttagctttccctatctccctaattgtcgagcgctatattggaattgattttgtcaccaccttcgttggcgcctttgtcttctcactcacctcttatttattaagcgcaaccactactctccccattaatcctaacctgattaatgcaggggcagtcatgccttttgtaccagggattgcttttacaaatgccgtaagagacctcatgaccaatcatatcaatacagggatgaccaaatttttccaaactgcgcttattatcttatcgctcggtgcaggtacaactgtggcctttatgcttgtgaggtaatctatgacaccagttcacttcttattacaggcactcgcctcttatatcgctatcgcagccttcttaattgttctcaatgttcaaagaaaaatgctggtccctggtggactcctaggcatgcttgtttggctcatctatctttcattattaggaccaactaatgtactgattgctacctttttcgcagcaattatcggatcctgtgtcagtcaaatcatgagtatttggttaaaaacaccctccgtcatcttttcattggctatacttgcaccacttgttccaggctatcgagcctacatgaccacgacttatttcgtttctggggaccacgctcaagccctaaccaatatcactaccgtcttaactttagccttagtcattcccatcggtatggccagcggaacaatattattacacctttataaggttcttcgaacaggcaaaaaagcagcctaaccccttgaaaataaggggcctttttgttaaaatgaaaacttatcaaaggagatgctatgaaccaaaacgtaaccaatctaaaacttgctgaacgtggtgccttgctatctatcggtgcctatattgtcttatcaggtatcaaactcgttgcaggacagctctttcattcggatgccttacgagcagatgccttcaataatatttctgatattatcggtaatatcgctgtacttgttggactaaaaatggcacagaaaccagctgataccgatcataaatttggacactggaaaatggaagacttggcaagcttgattacatccttcatcatgtttgtcgttggtttccaagtactctatgataccctccaaaaactaatcagcaattcttctatcgaagtagacattatgggggccattgtcggaattttttctgcactagttatgttagctgtttatttatataataaccgcttggcaaaaaaagtacgttccaaggccttagaagcagctgccaaggataatctatccgatgcagtcacttccataggaacttctatcgcgatctttgctgcggctttcaacttccctattgtcgataaaattgcagccatcatcattaccttctttatcctaaaaacagcctacgatatttttatggaaagcttctttaccctatctgatggatttgatgaaaacttattgaaaaagtacgaggaagatattctcaaactcccaaaaatcgtttctgtcaaatcacaacgtggtcggacttatggagccaatatctaccttgatgttgttttagaaatgaatccagacttatccgtttatgaaagtcatgaagtgactgagcaggttgagcaactcctaacactcaaacatggagtttttgatgtggatattcacgtagaaccatctgaaattccacacgatgagatgtatgagcatgtgtacgacaaactcttccgttttgaaacagagatacaagcacatgctaatgggtatgaagaattgattgacgaccagtatctcttaattgatgccaaaggccgctatcgaaataaaactcagatgcttgccgaccaccccatccaaaccacgtatttatccaattaccaaatgacctccattagccaaaaatcaaaattagttacgtttgaaattggtgattatgttcatacgtcactttggcgccgtcatgaaaattggactgttattttccaccagatttcaaagaaacaagcctctcagatcgaagctactgaaaaaagctctgatttgcataatccataataaaaaataggaattttccctgaattatagggagaattcctattttttaaccttccttttaagctattatcagtcttttatactcaatttgtagttatttagtttttgtttagtatatgataaaagctaaataactatagaagattagagcttactgttttgggatttcattgattattatattataaagaaaaagcctctacccgaataaatatttgagtagaggttttaactgaatgatattgcccattggcagggcttttatttgtttgttaatcaatcctaatatagcaaaggtgccaacagtaaaatcacaaataatgctaacaaatgcccaactgtcactaggataaacgaatacttgaggccacgtttcatacttaatttcgaaagattgtggaaggtaatcatcacaccagactgaggcataactgtcaaaatagccgatgcaactactactacacgatgcagcaactccggattaatccccatttccaaataggaaggaaggaaattacttgaagcaatacctatcgcaccagaagatgaaccgataataccactaatcaatgctgtcgaaacagataaactgattagaggtgatcctggtatttgttgaatccattcttgaatgactgcaaaacctgctgacaaagttaacacagtcccaaaggctactgtactagaagttgcaaaagcaggcactatagatgccgttgtcgcagcattcaaaatttctttttgatttggcagatatggataaaaaatcaaggctgatagaaggatagagaccaacaatccgattgccaggacattcggagttttactcattaggaaaatcgtcccaataagactgaatagaggcaagactgataaaaatagatttggtgtcttatcagctaccactactgcagtttcatcctcttcttccgtatacgtctctccatttgctagacttttcttgaggcagtaggccatgtagagcaagccaaatactaatagtgtcaagctggctgccaaactgataatgggtgccgcggtcaagctagttcccaaaacttttgtcggaatgacattctggatggaaggtgccccaggaagagttgtcatcgtataggtacctgctcccaaaaagacaggaatcggaaaaagtgcccagttgatattcaactctttaaagagggggcgtgaaaggggaagcaaggtaaaaataactacaaaaatactcacaccaccataggtcagaatggaagcaatcaaagtgatagctaacaagcccttatagggactatcctttcccattaccttcaaaatgctattggcgatcgtctgcgtagctccacttgcctccatataacgtgccaagatagaccccaacataaagatggcaaaattattaatcaaaaaacctgctaagcccgccatataagactgctctttgcccaacataacttccaaaacattcatctgattggtcagaatgatgattaaactagcgagtggtgcagcaatgataacatgtaaattttttgatgtccaataaataatggctacaatagccaataaaactcctaaagttgctaaaattgtcataaaactcctttatctattctatcctctaataaacctagtatcagaggcaactatttgaaaatttttatatctttttgttcccctagttctgcaagcaagtccgataccacttttttcaaaattgggtgacagtaatcagaagcaatctcagcaagaggtttgagaacaaatgctctttcatgggcgtagggatggggaacaatcagattctcttcttgaatcttctcctcatcccaaaaaataatatccaaatcaatggtccgttgtccccatttttcaatccgtactcggtccaactcttgttcgatgttctggaaaacgcttagaaaatcctgagcagacaaatcagtatacacttgacaggctagattgaggaaatcagcctggtcggtcttgccccaagctggagtttcataaatgttggaaactaagccaagctggcaacctggatgactggctaatttgtctagggctgcctgtaaataggcttgtcgattgcccatattccctccgatactgagataggctagatgcttcatggtcgttcacgctccaattcaattccgacagaatcatagtgtccagcaatgggcggattttccttgtaaatggccaagcgaatcttctccacctttggaaattgatcaaaaatctcctgacagatgacacctgccaccttttcaatgagaatatagggcttgccttccacaactgctttaatggtttcaaagaccataccatagtgaactgtgtcttctaaattgtcagtttgtgaagctgctgtcaggtcaacaaacaaatcacagtcaactgtgaaaatttgaccaagaacttgttcttctttgaaggcaccatggtagccgtaaaagcgacatttattgagagaaatcttatccatgttgacctccagaagtcaattggtcccaaaccttaacgatatcacggttggcagcgacattgtgaacacggaccattttacagcctttttggactgcccaggcagacaaggctgccgttgcttgatcgcggtcagtcggtaaactattgcccccaagcagataatccaccacgcgcttacgagatattccaaatagaacgggataaccaagggcagtaatctgttccaaaccttgtaagagatcaaggttatgttggacattctttgaaaagccaaatcctggatccaaccaaatctggtctgcggaaacaccagcatcaagtgctgcttgggcacgctcagctagaaagtttttgacctctccaacaacatccgcatagctttcgtctttctggttgtgcatgagaataattggtaccttgtactccgcagccagggccaacatatctccatcataaagtcctgcccagacatcatttaaaatatctgcgcctgcttccaaggctgcacgtgcagttcctgttttataggtatcgacgctgacaagacagtcatagttttctttgatagcgcggataatcggaaccacgcgagcaatctcgtcttcttcagacacaaatgttgcacctggccgagtggactcaccaccaacatcaatgacggtagcaccctcagccaacaacttttctacttgtaccaaggcagactccacctcattatagtgaccaccatctgaaaatgaatctggcgtcacattgagaatccccataatggttacttgattcgctaactgttcgattgacatagaacctcctatttattgtgaatcatggacaagagttcacggcgcaagatggcatcttccttgtatttgccaagagcaactgtggtcactgtcttactacctggcttgcgaataccacgcatgctcatgcacatgtgctctgcttcgaccatgacaaaaacaccttctggttcaagggcatcttgaagggcatgggcaacctgatgggtcaagcgttcctgcaattgagggcgacgacttgctacctccactgcacgcgccaatttgctaagacctgtcacacgccccttactcggaatataagctacatgggcaatgccataaaagggtaccaaatggtgttcacacatagaatgaaaaggaatatccttgaccaaaacaacctcttcatgaccttctgaaaagacagctgtaaattggtctttgggatcctcttctaggccgttaaacatttctaaatacatcttagcaacccgtttaggcgtatctaataaaccttcacgattcgggtcctcacccaataattccaataattgataaattgtttgttcgatttgttcttgttttgacatagtgcatcctaaatagtttgatgttcttattatacctcaaaaactgttttcagaaaagagctttcagtatgctaatcccaaaactgtcccctaccagagcaccaagcaggtgtccctactcccgcctttgtgatataataggaacaaactaactataaggagctactatgaccaagaaacctgtccaactggctacgatttgctacattgataatggcaaagaatttctcctgctccatcgcaataaaaaagaaaacgatgtccaccaggggaaatggattggggtcggtggtaagctggaacccggtgaaacaccgcaggcttgtgccattcgagaaatctttgaggaaactgggcttactgtaacgaagcatgctctaaaaggagtgataaccttcccagactttactccaaacactgactggtacacctatgtctttaagataactggttttgaaggaagtcttattgactgcaatgaaggtgacttagagtgggttccctatgaccaagtcttgtccaaaccaacttgggagggcgaccggcattttcaagaatggctattagaggacaaaccatttttttccgcttgcttccgctatgatggggacaaattgcttgattatagcgttgatttttatgaagaataagctaataaaaaacgaaaaagccttggaaatccagggcttctttgatattacaaatacttcttcttcggcatttgcttgttcaatacgacatccaaaggaccggctgacaatactgtatctaccaagcgtttatctgtaatttttttatcgaggagaacttgatattctaagatcagcgcttcttttttcttcttgtacttgagggaaatgagatccgcttgcttgcaggatgtaccaaattgtttctcaaaaaattggtcgtagtcaaaattcattggcactgttaccaagagatgacgacgattttgattgacttgagcaaagctgatgttctcaaaaatcaaaatacaagcagataggatgaccgtcataaagacagccaaacctaggaagcccattcctgtcgctagaccgatagccatcgctaagaggactgcaagcatttccttcgaagaacctgctgctgagcggaatttaattagactgaaagtccctgctaccgcaacacccgctcccaagttaccattaactaatgcaatgataacagcaatcaatgccggcatcagacttagtgtgatgacaaattcctttgtataattagatttatatttataaacagccgctaagagtacccccatggatagactaactccaaaaaccatggacatttgcgctaaggtaatattgctattggccgttgaaaagatactattaaacagctgcatgtttgcttacttcctctccagtgatgttgtgggcaagcttataggcattgccatattttgaaaatgattgcttttcgatttggtatttttcgagcagggctaccaaccagtctggtcgttcttctggaacttttacttccatgattactttggttgggtctaataggttcttaccaaatttaccttccattgcatccacatcgtagtctcgataaagtaagttcttatcgattgtgagacgaacttttttgtcttcgattcctttataggatacgcgatcgtagtagatatacatcttcggcttaatagtaccgtagcgttctctcaacatttcgagttctgaggttaccttatcatccttgattgtggaatcaatcactccattttcgatataatttgctacagaaacagggtttgaagttaaacggtatttatagccaattttattttcttttttcttgatttcaagaaaagcttgactcgattcagatggtgtcgcatcatagacacgcatccgaattttctcacgtccattctttttggcaagtgaatcttgaatcatatcaaaatcttcattatcaaagtagatattggtaatcgttgatgtcgcaaactcatctgccatcatgtactgacgaagttccttttctaaaagttcaaaagtttttttatcaacgatatatttagtctctttacgcttaaactgcttttgtacgattcttgttttcattattgtgcctcttctatcctaaattttgacaggtccctgtcttgtttacaagatatagtttaccgacctagctttaaatgaaactgaaaataaaattaaacaaaacttaaactgcaataaagttgaaattcttttgtcacattctaatctatgctacaatagtcctatcaatagtaaggcaaggagaaacccatgtacgaatttgtcctagaatacggctctttccccgtaaaactcatcgacggttttgtcaacaatcgctcagaaatccctgattttctcaaagaagacgaagaaatgattgcccgcttgaatgagattaacgaactcttccaccaacttttcttaaccatcgagtgcaagtttgactacatcggcaaacaatttcctgacaagatcgaacaactacgagaactctatcatcccctggcagacgatttactagccaagtatggcaaccagatagagttgaagattgaaccctttattttgtaagacaaaagagatgaccgcaatcatctcttttcttctattctgtattccaaaccatattggtcacgcgacaagtagccgtagtccaccaagtagcgtctcaatatagcataatcatcatagacttcagctagaaaggcattgacttctttttctgtgaaggtagagcctttcttagccaactcttcttgtaaataggcaaataaaacttgcttactttttaattttttaggaataacgataagcttgccttctcgaaaaaatttttcttgaatatcttgagtgttcatacttccctccaaaaaatcccagcccgctgactaggatttcacaagatttacatgttaacgaatttcagctccaagtgtttcgagcgacttactgattttctccatgtacttagccacttcctcatccgtcaagctatcctcaggattctggaaggtcaggttataagccatagacttcttaccaacctcgatattgctgccagcatagacgtcaaagagagtcaccttggtcaagcgtttcacgccagcaccagcaatggcatccaggacatcctgatgtttgacatcgctgttcaaaagcagggcaatatcacggctaaccgctgggaatttagagatgtcggtaaatggctgagcaggctggagggcttcttcaatcgcatccagattgatttcagccacataagtttcaggaataccgtagtccttagccgtttgagggtgtacctgaccgacaaagccgatcacagccccattcaaatggatttcagctgtacgacctgggtgcagggcagcaatctcactagtcgccacaaagtcaactgccaacttgtaatgatcaaagatagcttccaaaatccctttggcatggaagaaatcaactggtacagctggtgtctggaagtctttctcagcaaccaaaccagtcaaaacaagggcaaacttgttgatttcttgtggcaggtcctcttttggattgccagactgttcaaagatcttaccgatttcgtaaagagccaaattcttgttcttacgagccacgttgtaggccactgtgtctaacataccagacaccatgttctgacggagggcagagcggtcaactgtcatcggccacatgagttcggtgactgtggttggacgagccacaaactccacagccttgtcaggcgttgtcaaggcataggaaatgatttctgtcagacctgcaccttcagccaggctacgtacttggcgacggatgttctgggtcagggtcaactcgcctgctgttccgtcctctttcggaagagtggtcggcagattattgtaaccatagatacgagcgatttcctctaccaagtctgctggaatgcgaatgtcccaacgacgacgcggtactgctactgtaaactgacttgcatcgccagttgtttccatacctaaacgacggaaaatatctgcgatttgggcatagtcgaggttggtcccaagcgagcggttaacgtaatcaatggttgctgtgactgggacatccgaagtgtccacgctgcccgcagaaacgatgccagacaagacctgaccgccagccagttccgcaatcatagcagccgctgtgtccatagcctccgtcaaagttgctacgttgatgcctttttcaaagcgagaagaggactcagaccgaaggttgaggcgacctgaggtcttgcggatagacttgccgtcaaagagggctgcttccagcacgacggtcttagagctattgtcaatctctgtactagcaccacccatgacaccaccgagggcaactgccttgtccgcaacggaaatgacgatgtcatcggcaatcaagtcacgttcttcgccgtcaagagttaccaagttctcaccctcttttgcctgacgagccacgattttcttgccttcaaatttatcgaaatcaaaggcgtgcattggctgaccgaagtagagcaagatgtagttggtgatgtccaccacattgttgagcgggcgaatacctgcgttcatgagcaggttttgcaaccactgcgggctcggtgcgatagtcacattttcaataacacgggccgtgtaggcagtcaccttgtctgactcaatggccacttcaatcacatcgctggctttcttgtcgctttcctccaagaccactggcttgaagttgaccttgctgtcatagatagctgccacttcgtgagccacaccacgcatagagagggcgtcggcacggtttggtgtgatggacaactcaataatctcgtcgtcgaggtcaagatatgaaaagactggctcacccacgactgcatcttctggcaggtggtagataccgtccgcatagacctttggcacaactgagtcggacacgccgatttcgctcaatgagcagagcatgcccaaggattcaactccgcggattttgcctttcttaatcttgtagttgccagcgatacgagctcctggcagagcaacgatcaccttgatacctggcttgacatttggagcaccgcaaacaatttgcgtgattgcttcgcccacatttacctgacaaatattgaggtgagtatctggaattggctcagcagacacaacctgaccgacaaccaacttagaaaggccagcactcttttgctcaaccccttctacttcaattcctgttgttgacattttttcagacaagtcatggcttgtcgcatcaaagtcaacgagttcttttaaccatttgtaacttactaacatattatcctttctggtgcaaaggccgtttcagtagccaatccacatcaatcttatcaccgaccgcaaattcatgctggccaaatttttcaaatccgtatttggaatagaatttctgagccttgtaattatgttcccaaactcccagccagacccaatcacaactagactgctctgctttttccaaagcaaattcaaacaagaccttcccaagaccgcgaccttgataggcctgcaagagatagatacgctggatttcaaaggcattttccaactcttgctccgtctgggcagaacctttgttgagcttgagataaccagctatctgatgatctattcttagaaaatagtgctggcagttgggatccgataactcactagtcaagacctccaaggaataagattcctcaaagaatgcctccagttccttcgggtcattatcgtgagcgaaggtctctgcaaaagtctgcttggccaactcctgcaaaacggaaacctcttccaaacgtataggatcaatctgcatctcattgcctctcatttctaactggactaggaaagtcgcagagcaacgatacccacaccttaaatagtgcgagattacgacggttcaaggttgaaaacgacatatttttcaaccttgaacctagtgaggggagtaggtagaccgccatagcggctaccgtcctgtttctagatactttcagtatcagaaacaggtctcacatcaaaactgctccgagaatcgtacatcaccttgatagaaaccacggatgtcgttgataccgtaacggagcatggcaatgcgttcctgaccaagaccgaaggcaaagccagagtacttggttgagtcaataccactcatttccaatacttgcgggtggaccatgccggcaccgaggatttcaatccagcctgttttcttacatacattacagccgtcaccaccgcacttgaagcaggaaacatccacctcaacagaaggctcagtgaatgggaagtatgatggacgcaggcgaatctgacgctcttcaccaaacattttcttgataatcatttcaagcgtacctttgagatcgcccatggatacattttcaccgacaaccaagccttcaatctggtggaactggtggctgtgggtcgcatcatccgtatcacgacggaaaacacgtcctggcgaaatcatcttcaaagcaccttttgagaaatcatgctggtccatggtacgcgcctgaacaggcgacgtatgggtcctcataaggatttcttctgtgatgtagaaggtatcttgcatatcacgggctggatgatctttcggcaaattcatcctctcaaagttgtagtagtctttttccacttcaaatccgtcaacgatttggaagcccatgcccaagaaaatatcttcaatttcttcagaagtttgggtcaagacatggcgttttccgaccttaacctgacgacctggcaaggtcacatcaatggtttcggaagctagttgttgctgaatttttgctgctgcaaccttttgagcagtttcttcaaaggcagttgtcagcacatcacgcacttcattaacctgtttaccaacgattggtttcatgtcgttagacaggtctttcaagcctttcaataagtccgtcaaagacccttttttacccaaaaccgcaacacgcaggtcttgtagttctttttctccttggtgctggatttcttttaacttttctagtgtcgtttggcttaattcagccaactgttgttcaatgtttgacataattcctccaataaaaaacgcatgacaccactcgtatcggagcgttgtcacgcggtaccatccgttttcatctgcaaggcagaccttagttctatgaacctatattcacaagtgaagtgcttgcacataagagatggttttccgctaatcaaggctgttttttgagggaatactgactgtattttgaaaaaaactaacgatgagtagctgaaaaactagccttagatggaagtgttgaactgtgaatgcaggttctaagtccttgtgtgagtgaattcgaccaactttcactgattgagcttgcagtcacggctcaactccctggacagcttccataaggtgtactagtctcacagacttctattcaattaaggatattttatcaaaaagaagaaagtttggcaagaaatcttcctagaaaactccctctatctaggatagaaaggagtttagttttatagttttgcctgccatttattggcccaaacattctcatttggcacaccaaagaatgcgtcttttccttctaatttatcaagtaaggattcgatagtatttttattgtgatggtaggcattgatagcagttttgaccatggtaacatcgtgaaggtgagttgtatagtttagtgaaatgaaaatggttggaacttcatgtacataccaaggaacttcatttgacatggccgttttccactggatgcggtaattattctgcgctccatatccaatgacattggcaacagtcaaggctaaatcaacttcttctcggtattgcagcgtttttcctttgatccgagtcgtaccatcattgacggtcacttcatagccacgcgcttccaaggcagctttaaggttatcaaccacttctgtacttgccgccataatcccttctttttcaccttctaggtaatacaatcggattctgcgatgggtttctggactgattggaagatttttctgtgtatctttcaacagcgtaattgccttgtctgccgcctcacgttgccaagccaagtgttcttcacagccgataatagccaattcatcagctgattttagtaaggttccttccgcttgcttgatatgcagattgagtttggctttcagacctaaaatgcgacggagagcatcatgaaggcgttcgtcagtaatcactcccttgcggtagccattgagcataaattcaaaatcttcttctaagttattgaagaataagaacatatcgcaacccgcagcaatggctgcaggtacgtagtcttcacgacgcatggctgctgtcatccccaacatgtggctggcatctgttatgaccaagccattgaattccagtttttctttcaataaatcttggatcaattcaggagccagcgttgcaggcaaaatatcttcgtccgtcaaacttggattgagtcgttgttggtaatatggcaaggctatatgtcccgccataatcatctcaacaccagcttcaatatgatgacgatagacacgaccaaagctcttgtcccattcttctggagagagctcattgacgcctaggactaggtgctgatcacgttcttctttaccatctcctgggaaatgcttgatacattgaataacatctctttcagcagtcaatccttctaaataggcactggtataggtaataacatcatccgcatttgtaccgtaggctctggtattgacgatagtattgcgccagttctgaacaatgtccacgcaaggatcaaaattgacatttacacctaatgcagtctcctcacgcgcagatacgagacctgctaggtagggaatacgaggatcccgactggcttccgattgagcacctgaggaaatataggttcctcctttcacagctccatctccacctgagtcacagttcgctgcaaccaagagaggtacttttgaatagctttgcagctcgttaatcagtccttgtacctgttctggactgccattcatataacgggcaccacctatgtggtatcgattcatcaattcctgattactcagattatttccgctaaaagcgtctcctccgaagaagaatagattaacaaacaattgaccgattttttcttcatcagtcagatgagccaaggtattttctacccaggtaatctgctcatcattcaaacaatagggtttcttccgcaaatcaaccaatctaggcattctttcctccttattttccgcgccaaatctgtgtatctaccaagccacagtaggcatcaacaggcgatactcctgtaaaggctgactctcctgctagtttagcaaccaaggcttctaatgtgacaggcaagccatcgtaggcattgatataggttgcaacctgtggcatatctgcaagtgcaaatgggtgctgaacagagacaataatggttggaatttcgtgaacatagaaaggctggtctggtgttcccttggcagctggccaaataattcgctgagttgttcctcctgagttgacatcaactaaattgataatcaaatcatagttatctgtgatttccgcaattggacgcttggaagcatagacatttgcaatcgctgctggtctttcttcttctggcaatttggcaatccgtgcctccgtattttcccagatagatacttggtgacctcgagcttctaatagttctttcagcgtatcggctgctctcttcttgccagcattgatcatggcaccaaaaccacccttatagccatctacttcgaccaacaaaatacgtttgtagcgttctggattgactgggaaaattccttcttgtttggcttttaccaaggtaatcgccttgtcagctacttcttttgcaagctgtttcgcctcatctctaccaatcaaagccagtgcttcttcttttggcaacatgatttcctgacgacgaccttcaaacaagtgaagaccgagtttagctttcaagcccaaggtacgacgaagggcatcatggaggcgttcctcagaaagcagaccattttccaatccttctttcatccattgcaaatcttcttctggatcgttgaagaaaaggaaaagatcacatcctgcctcaatagctgtaggcaatagctcacgacgcggcatagaggctgtcataccgatcatgtgactggcatccgtgacaatggcaccattgtaacctaactctccacgaagcaattcatccaagagggttttattcagcgaagctggcaacatgtcatccaattcacgttctggatgcatttctttctcaacatttggcaaatgaatgtgccccgccataatacctgggagacctgcgtcagccatctcaccataaatccgtccaaatgtttccatccattcagacttggtcatgggattcgaagcgaaagacaaatgatgatctcgttcgtcaataccatctccaggaaaatgcttagcaaacggcacaatgccatgttccataatgcctcgcatgtattctttggacaattcaatgacttggtctacattagctccccatgttcggtttgcaatgattggattgcgccaattacggcttaggtccataatcggtgcaaaggaggcattgcagcctaccgcagctgcttcaagtcctgcaactttccccatttcataagcatagcggggatcggttgtcgcagcaatcttgatttcatccccaattttcgttccatccgtaacagcgccatttccaccagattcggtattggctgcaatcaagaggggaatcttagacttggtctgcaaaatatagttttgctcccaaatatctgcagcaggtccaggattgtaacgaacagcagcaatcttataatcatttaatactccagtcagatagtcttctgtccgctggctccccatgttgacaaagaggtgaccgattttttcatccaaggtcatctgagcaatggtttcttcaatccaagaaatagcctcttcatcaaggctgtaaggtttcttccgtaaatctactaaatgtgtcatgtttgcctccaaaaaagctagagggcatagcgcctctagcccttctctagtcgtctaaattattccaaaatgcctgtatcaattctgtttctttctcacctgtgaatgcttgatgagcaaagtcatctgcaatcgtttctgtcaaatctgcccaagattgcatctctcgtcctactaaaataggatagaaatggacaccattcaattccgccgccttcaaatcaccaggcgagtcaccaatcatcataatcttattaggacaatacccttcctctattaacagtttgatgacatcttctttcttgccacggtcttgacagtacaattctgtaacaaagtccatcaaaccttggtctgtccactcttcttctactgcttccttattagcagaagaaactacgtagacttttcctaactggctcaatttttccaagcccttgtgaacgccgatgaaggctaaaacaggaccactataatgcttaatggcttgattgacttgagtggaccattttaaggctaattccaagtcttttgacggctgctcctctatcaatctttccagagaagcatttgacaaagaatctgtggtcgcgacccaatttttcaagttgtctataccagtcacacctgcaaattctaggcctttaactaagccaacaaaacggttaatgccacgttctcgtgagtagagattaactcgattccattcagctaaaaacggttctttatcttcaacaccaaaaacttccgcagctaaggggccgaagaaaagcttatgtttgtaggtcatggtgtccatggcgcagccatcagagtccacacaaaatacgtattccatcttcatcatcagactcctgaataggctgagaagccaccgtcaatcggtaaaacaacaccgttgacaaaacttgccaaattctcatctgccaagaagaagacgccgccgactagctcttccgattcaccaaaccgtcccattggtgtattggtcaaaatcttgttggcacgtgcggtcggttgacctgactcgtcaaaaagcaaaccacggttttggttggttaccaaaaatcccggagcaatggcgttgcaacgaatactaacttttgaaaaatgtactgccaaccattgggtaaaattactgatggcagccttagcacctgaataggcaggaatttttgtcaaaggagtaaaggcattcatgctggagatattgataatatttgctccgctacggccaatcatatcctgtgcaaagacctgtgttggcaataaggttcctagataattcagattgaaaacaaagttaatccccgcctcatctaggtcaaagaaggttttcgtatccgctggaagacccacttcatggaactcattatccgttgtcgctttcggattattgccacctgctccgttgattaaaatatctaccggaccgaaatctgccaatacctgttggcgaacttcttccaaattttccttggaaaggacattagatttgtaagccttggcactacctcctgctgcaacaatctcatcaacaaaaacttgggctgctgcttgatttaagtctaaaagagccaccttggcaccagccttagcaaattccttggctaaataaccacaaagtactccgcctgctcctgtaatgacaacaaccttgtccttaaattcaatgacacgcgtcatagttatccctcctttgttccaactgtttttgctttaataccaaaatctggtgttttgccagccgctcgcatattggcttcgtatagaccattaaagtaagtcgccccgagcgctcggtcatacagaccgtagcccggtgtcttggtctgatctccccagatacgacgaccatgatctggacgcaaagaaccttgccaatcatagtccaccaataatttaacaacagcattcatatcaatgtcaccagcctgtgacaaatgtgcagtttcttggaagccccaagcacctgccgtcacattgcgcgtatgcataaaattgatacgattgcgtttgagagcatattccgtcatggcaaggacatcatttttcggatcagaagcataggatccgacacacatggtaattccattgtgttctgaatcatagagattcaaaaatcgttcaacggcttcttgaccagtaataatacgtggcaatccgaaaattccatacggagggtcatcagggtgaatggccattttgacgccagcctcctcagccgttggcagaatcgctttgataaaatactccaaattcgcccataaatcttcttcagagatattctgacgataattttcaataatagccttcatttcttccttggaataggacgaatcccaacctggtaagttcaaatcatccgccacaggatcaacacctgctaaatcagattttaggaaagctaaagaggttgaaccatccggaagtgggtggtgcaagtctgaacgggtccagtcaaacacaggcatgaaattgtagcaaacaactggaatacctgcagccccgacattacggatggaagtcttatagttttcgattaaggcatcacgatttggcttcccttgtttgatgtcttcatgaacaggaatggattcaataacagtaatttcaagtcctgcctcttctaccatttttttcagctctagaatgttttcaaggggccatgcctgaccaactggtacatcgtagactgccgttacgattccctgcataccagggattgctttaatctcttccagtgtcacaggatcttttttcccgtaccagcgaaatgacattttcatgatttactctccttctattgttcaaaaaactctttggcattgtaataggatatggcttctacaaattgccctaaacgattgtaatcttctggcacttcttcatcaacaatccattgaccaacataggtcgctaaaatgcgtctgaaataatcatgccgttgataagataaaaagctacgcgaatctgtcaacataccaacgaaattggcaagcatgccctgttctgcataagcattcatctggtcaatcatgcccaactttgtatcattgaaccaccaaccagcaccaaattgtagctgactacgaaccccttcctcattggactggaaattcgccaaagtattggccagagcaatgttgtaacttggattgagattgtaccaaatcatttttggaagggcattttccttgaccaagttatctaagaaacgattcaaattcacagtcagacatgtctggtctccaatcgaatccacacctacatctgctccaagtttttcaaacagtccggtatggttattccgtaaggcaccgaagtgaacttgtgtcacaaagccatgtttcttgtacaatcggcacaattctctaaagatagcagtctgccatttattgatactggattgaccagcttctttacctgcaagtcttgctagtaaaatttcatccaactcttcgagggtagcctcttcataggaaatagccgtaaaactgatgtcacttgctcggcaaccgtgttgagcaaaataggaaacacgctgaccaagtgcctctacaaaacttgcaaagtctcttactgctacccctgttacctcctccaagcgtttaataaatggattgaaatttcgatgttctataaaagcttcatctggtcggaaagtcggtgccactacagtatctatggtcgagtcctcagccaagcgcttatgccattccaagctatcaagaggatggtcagttgtcccaataaaggtcaccctaacatccgcaatcagcttccgtggactaacttgatgttcttgcaaataagcattgagctgatgatagagtcgctctgcattttcttcggtcaacaattcctcaacaccgaaaacctgtcgcaattccaaatgactccaatgatagagaggatttccgaaagcccgttccaaggttcttgcccaggccttaaacttatctagtttacttgctgaacctgtgatttcttcttctgagataccattagcccgcatcaagcgccacttataatggtcaccccccagccacaaatcaacaatatcttcataaaccttatcttcaaaaatttccttcggatccagatgacaatggaaatcatagataggaagctctgctattttcccgtaaagctccttagcaggctcgttttttagcataaagtttttgtcattaaaactcatttcatccctccaaagctgcaacaaaactgcgagcaatcgtcgttacactttcatagccttcagcctgcactcgacttgccagagccgaaccgactccaacagcacaagcacctgcctttttccaatctgcaacattttcaaccgaaactccacctgaaggcatcaaattcacatcaggaacagggccgtgaatatccttgataaatccaggacccaagacaccaccagggaaaagcttgataataggacatcccgcctgactagctgtgacaatctctgttgcagttgcacaacctgggaagtagaatacctcagcctcttgcgccaagtcttgaatttctttatcaaaatgaggactaaccaggaaactagcacctgcatcaatggccgcttgtgccagcttaagattcatcactgttcccgccccaatgactacggatgaatcatctgagaactcctcttgtaattctttgataactgtcgctgcatttggagtcgaaaatgtaatttcaatatttcgaatacctcccaaaatcgcatggcgagcgatctctttcgcatcttcttcatcttttccgcgaatcactgcgaaaaagtaattttcttttaattgctttaacatcttgacctccaattagaaagcgttgtcatttatagctatagtatacaattcatcagatgatttgtcaataaaaaagcaaaaaatacccagaagaattcttctgggctgtctattttttatttctatttatgatcgttgagaccatgcaaggtcatatctttatcgaaccattcgcttaaaacaacctgtcttactgatataatatgtgctaacatgctatcatatgctgcaacagggtgacgttgcttgatagccattaagatattcctgtgggcctgtaaactatccgatttcatctgacgatttgaatagttttcattgattagatgaatagattgattaatgacaggcatgagacttgtcatagccagattcccactcatctcagccagcatacagtggaattttacatccaactccagatgcttcgtgtctccagcagcaacagcctcttcaatagcaaggacaatttcttctagtcgagcaatgtcttcgtccgaggcaaactgagcgacacgctccgcaattctcggttcaagtaaataccgcacttcaaacaaatctgtcgtcaacttcacacggtctcttaccaaagaaaaacctaggggatcctctgatactccttttttagagctgatataggttcccgacccttggcgcacctccagaatatttcgagtagccaaacttcgcacagcttcacgaacagtcgaacgtccaacttctaaatcttgggccaattcatactcatttggaagcttatcaccaacttcatatcctctttccaaaatcaattccaataagcgctctgatgctttttctaccaagggtttcgccatgtgcttggtcctccaatacaactttctatttgctactattatagctcatttcctcttataatggtagtttggaatggcagtccaacgtttcttgatttctcttacaatttgcttgggttgtctatttcttgagaataatcctttgtgatttccttgaatgcgaatgataccgactgtagtttcaaaatcagcaaaattccatacctgctcaccaactaaattcggaattgaatcaaagacgcaatggttcatatcgtagtaatccacctgaaattcctctgtataaggaatatcccacatcgaatgcaaacctggaagagtatctgcaccatattccgtaatcaaaatcggcttgtcaggataaagtttttgccaagtctccaactcttgacggagccctttctctgccgccttcaagtcaccatgagcaacataccaaccatagtaacgattgagacagacaacatcgaccaaatccataacctcatccttatcaggcgttgctgtcataatattgaccaaggtcacaggacgcttagacggatctctgtccctcatgcgctgaatcagaggttcaaagtaagcacgtgctcccttttcatgccctgccggttcattggcaacaacccacatcactacagaaggatgattcttatcacgcgctatcaattcatcaatcaccagctcatgagcctccttggtttgcataacttcccaagtattttttgcttcttcagaatcccctgtcaaattcaaggctgcattgaaaagctggaacaggccaactgctggcacttcatcaaggacgacaattcccaaacgatctgccagccgcatcatttcctcagaatagggataatgagatgtcctaaaggaatttgctccaatatctttaagcaaattcaaatccatcagattggctgcttcattgaaaccacgcccattgatgaaggtatcttcatgtttaccaaatcccttgaaatagaaaggttttccattgatgaaaaactgcccattttcaaccgcaacactacgaatgccgaattgttctgagtaggtatcgagtaagttttctccgtcaactaattcaactttagcagtatagagataggcatccaagacctcccaaaggcgtggatgttcaatgaccatttgtccattttcaagaagacctacttcctgtccctcttgatctaaaatagacatacggatggaatcgtactgcccaactgtcttcacatcaacattcactaccgcctgagtcaaatcttgatttagctccgtccgaataacaatatcctcaatcctattttggggacgtttatagagatgaactgtccgctggataccagcatagttgaaaaagtcaaaattttccttgacggtcttcacaatttgaccattctcatccacttcttcgctataattccctactgggagggttgtgtaattcaactcattattagcacaaaccgtcaaacggaattgatcagcgtcgtataagtttgacggaatcaagcattcaaaaggtgtgaaaccacccttgtgctccctgattaactgaccatctgcatagactttagcctgatgtgtcaccgaaccaaagcgtacaactaactcttcatcatcagctactactggaagagctaccatcagttcataccaattatctccgacaaaacgacgtttgtccttatcaacaacaacatcattaaaagaactcggtacaaccattacctcatctgtatctaacagagtatgaacatcattgttcccttgcttaaatttccatattccatttaaagaataaactgagcgtgtttttgtctgtattggatacaacatactttttccttctttctatcgttttatttcacgtgacccttttttcaatagcaaagcaatatctgacggactgatgacattgacatcaccttcaatggtatgtttgaattgaaaactagccatccccaagtcgactatttcctgtggcgttttttcctgcaaatagcccaaaataattcctgctgtaaaggcatcccctgtcccaactcggtccaaaacttgaatggattctttttccgtttcataaagaataccatcttgatacaaatatgctttcagcaaatattcattattgtaggtcatttccctctgggtaaaagcaagactttgcaaagaatacgtctccgccagacctttaaccaccgccaacaagacttctttattttcataagggcgcttcaaccccaattcatccttcacatcttttccagattcattgaagagttgaataggctctagaccaaagcaaatatctgctaaacctacaaaaggagataatttctccctcgcttcttcaaaagaagaccacaaactttctcgataattcaagtcaaaagaaaccttaacaccctgcctctttgccatttccatcaaacgaaaggccagtcgataaatatctggattcaaagcgaccgttataccactgacatgaaaccaatcgacaccgtcaaacataccttccaaatcatactcttcttccttggataagctaaaggcagaataatcacggtcgtaggtcacctggctaggtctaagagagaagcccttttgataataataaatccccagccttcctttttttcgaatcagatgcttctgtccaatctgccgtgcaaagagaaagtgttctgccatctttcccacttcattttcaggaagtgccgtcaccaactcaactgaatgccccaactgtgctaaactggccaagacattcaactctgagccaccaaactgacaatctaaactggtagcttgtgttagggtctgataatgaggaggagatagccgcaataaaacttctccaaacgctaagatttttttcataccgcctcctagatgaaagacccagctggaatcctccaactaggtcgttattgtattatttatcgtcgtattgatcaaccttatattgagtaacatctacataatccatatcagataatggaacatttttcgcaatcgcacgcacacgttcctcatcttttgccgctttcataacatggattttctcttgaatacgtgccatttcttcacgatctagtttgtaaaatttcatcaagaacaaggatacgctcaataccactgctggaatcactgtcaataggacaatcaaagccattctcaaatctgttgagaatgctgtttcaacggttgggtactctttaccaaaaccaatacctgctaatacaaatccaacaaccattggggcaaatgaagaagcaattgagtctgtcaatgagaagatagtcccaatcatacctgacaagtaacgaccagatactgaagtttcatagtctgtaatatctgcccccattgtcaataccaaaccagatggagcactagatgcgtagcgagcaatgatataaacaacaaagaagccgattgtgtagagattccaatttgtcaaatccaacatacctggtttagctgaaaagagcatcgctgccaaggtcacaagaccagcaatcccaagttgaagcgctgtaatataggcaaagcgtaaacctttacgacgagccaattgcgcagcaccaactgttacaagaatacctggcaaaatcaacagcatagacattttaccagaaagagcatagtcaccgaagataataccatacagcataaccctgataacggaatctccaaacagttgagcaacaaattttacaaaagctgcagagattgaaagaacctgcaaaggtttgtttcctttgataactttccagtagtctttcaacttagtttcttgtgtcttctcaccaagaccaaagtatttcttattgtctttctcccaaataccgataatagcaagaatacccagaacagctgaaattactactacaccgaggaacaattcttggaagaaacttcgagtgaaaccaccatgttttggaaccaatgtccctgacacaacaacctgactaccagtcatcaacacagttgtcgcaataccatcaacaatattaaagattggacgttgctttggatcattggtaagcgcaacttgtcctgcttttgtaatcgtctgttgaagtgaatatccaattttatggataatcaaaacaaggatgaatagaggaagacggagactctcgctaactccacttaaacctaacatcataaaaagagaagctgctgtaatgatattccccaaaaccaaaataggacgatatttaccaaacttagtatccgttttatcaatgataactccgattgtaggatcaatgaaaccatcaaagatacgaatataccccatcagttgactaacaaacagggctgcaagaccaagcacacctgtcgataaataagtcacgaaagtaaaagcaaccaagtaaatattcgtcgatgaattgttcatcgcaaataatatgatttgccataacttggctttgttataagtaacgtcttcgacacgttgctcaacatgtttttccattggaaattcctcctaaatgttttctacgacaaagtcgtaagcgttttctttaactatattctaatattcatcagatgatttgtcaactgtttttgtaaatatttttaattatacgcaaaaaaagacgattttacgtgaaaatcgtctgatatatttgatttaacgagggagaattcgtctgactatttattgatttactgcaatttccccactatgatagttgatactgagaccactctgcacatttggaacgaacacattgaactctaggctaccatctgctgcttttgcctctagatgacttccgacaggaacaaggtcttcactctcagcatacaccaaggtcacacgatagcggacacgcttatttttatccaaggcccgccgaatctgactttcaaaataattctgcccagttgaagtttggtcgttagcttggttggaccaagctgtttgaactgcaatattcttaggattgctggttgaagcatcgaagccagacaatccaccaatcaaagcataacctaggaggtgaccacggtccactgcatggtcatattctccagttaaatcatggatctgatgccaacccgcaggtgtccaagaagttcgaccatttcctgtttcttcacgatccttatactgacgtgtagatttagctaaaagcgcattggctactgttggaaccgtttctccctggactgtttttgtcttattatcaccataaggaacactggcaaccgatgcatctaaatccgtttgattcccgttaataataaacgctccagcactattccattcaatcgaatttcccagttgcttttttacatcttctgtcaataccgaactagccagttcctgattaggtgtgccttcacttgccttagactgattgacataataggaataatcagcaacgttgctactcttgttatcacttaaaagatagccacccgctactacaacaatcgtagccaataagctgagcagactcattgcttgtttttttacatttttcttcgccattttctctccatcaaaaaagcaggtccagcctactttcctgtaaatttaccgattaattcttgccacttagctggtgacaacaccgcaaatacattgtctccatctcctatgacaccgtaaccaaccattaatcctaaaataaacaccaaaatagcaatcaacaaaacaactgctactaagattaaatttttaccaacatagctaagattatccttatccattttcatcttctccactcacacgttcaatcgttgcacctaaagcagctaatttctcatgaaaacgatagtaacctcgatctaagtgcgttaatttacctacaatcgtttcaccttcagcgaccaaaccagccagaatcaaagcggcacttgctcgtaaatcagtagacataacctgagcaccttgcagagcaagtcctcccgtgatgatagctgtatctcgtaaaatttccgaatgcaaatccatccgacgcatttcttccaaatgctggaaacgattctcaaataccgtttcaatcatggtagattcaccctttgcaactgccattagagctgtaaattgagcctgcatatccgttgggaatcctggatggggcaaggtttttactgttacaggtttaagcttatccacttgcgaacgaactcgaatcccttcagcttcttccgtcacctcaactcccatttccaacatcttagaaatgagtggacggttatgctcccagacagcgtccttgaccaagacatctccaccagtcattgccgctgccaccataaaggtacccgcttcgatacgatcttgcaccacttgatgttctgcgccagtcaattcttctacaccagtaatcgtaatcgtctctgtacctgcccccttaacttttgcccccattttgtttaggaaaatagccaagtcaacaatttcaggttctcgcgctgcattttctaataccgttgtaccctgcgccagagttgcagccatcatcaaattttgcgttgccccaacacttgggaaatcaagatagatatgagctccctgcaagttctctgcactcgcttcaatataaccagcgcgttgtttaattttagcccccatagcttgcaaaccttttaagtgcaaatcaattggacgactaccaattgtacaacctcctggcatagaaaccttagcatagccattgcgtgccaaaatcggaccaagaataacaatagaggcgcgcatttgactcacatacttataaggagtttcactaccaagtttacctgttgcatcaatatcgatagtctttgtttcctcgtcaaatttcacacgaactcccagaccacgtacaacattattcattgtatagacatcagacaaaataggaacctgggtcaatttggtttgcccttgacttgctagaactgttgctgccaataaaggcagaacggcattcttcgccccctcaatctcaacctgtcctttcaaaccgtttttactacctgtaataataattgtatccatttcttatccttttcttacttaaatcacatatttgcaaaagagcgtcccatcatcaacaattctaaaaagaaagtcgagactaagtaccccagtgctattgccagaaagagaatcagcaaattgattttacgctgattgtccccagtcaccttcaaccaccgtgaccaatcaactgttgtaaccaagagatgatgagccagatagataaacaatatatgactaaaaaactgtaaaattgaaattaccatgtttccattataccatgaaattaaaaaatggaactgaaccaagttcaatcccatatagattaatgtttcccaacacgaatacgatttatcgcacgttggagggcgactgttgcacgcatttccatatcaatattacgagcagtctgtgcttcttccaattcacgttccgcgcgcaatttggcacgttccgcacgactaatatcaatatcccgttcccgctcagcggaatcagaaatgaccgtaataatatccttgttgacttcaatgattccaccattgaccgcaatccagtctacatggttttcatcatcaacacgacgcactttcatttcaccgatttccaaaactgcaatcagttcttcatgtccagaatagacacccatctcaccatcaaccgttttgaccaaaacaaatgctgcatgatggtcatatttgataccgtctggtgttacgatttgtacagtcatttgtcccataagccacctctagaatttcattttagcagctttagcgaccacatcctcaattgaaccaacatttcggaaggcatcttctggtagatggtcgtgtttgccgtccaagatttccttaaagcctttcaccgtttcagctactggcacataagaacctggcatacctgtaaattgctccgcaacgttgaagttttgagagaggaagaattggatacgacgagcgcgaccaaccaaggtcttctcttcatctgataattcatccataccgagaatggcaataatatcttgcaattcttggtaacgttgaaggacacgttttacttccatagctactgcatagtgctcttcaccaacgatttgtggagcaagtgcacgtgatgacgaagccaatggatccaccgcagggtagataccaagctgagtcaacttacgctccaagttagttgttgaatccaagtgagcgaaggctgtcgctggagctgggtctgtatagtcatccgcaggtacgtaaatagcctgaatagatgtaacagaacccttcttggttgaggtaatacgctcctgcaattgtcccatctccgtcgcaagtgttggctgataaccaacggctgatggcatacgacccaagagggcagacacttctgaaccagcctgtgtgaaacggaagatattatcgatgaacagaagaacatcctgcccttccacatcacggaagtattccgcaatagtcaaaccagtaagagcaacacgcatacgggctcctggtggctcattcatctgaccaaataccatggccgttttttcaataacacctgattctttcatttcccagtaaagatcgttcccttcacgggtacgctcgccaactccggtaaatacagagataccaccgtgttcttgggcaatattgtgaatcaattcttggataagaacggttttaccaacaccagcaccaccgaagagaccaaccttaccaccttttagataaggtgctaggaggtcgataaccttaatccctgtttccaaaatttcgcttgaagtagataattcgtcaaaagccggcgctttcttatggataggctcacgttcaaaatctgccggaaaagactcttcaaggtcaatggtatctcccaacacattgaagacacgacccagcgtttctttaccgactggaacagagatgggacgacctgtatcgagaacttccatcccacgtgtcaatccatccgttgattccatggcaatggtccgtacaacgccatcaccaagttccaaagccacttcaagcacgactttttgtttggaatcatcatttttatatacaacgagtgcgttgttaatctcaggaagtttatcttctgctgcaaacgcaacgtctacaactggtccgacaacctgagtaattttgcctgaactcattctatttcctctatttctattactcaagggctgaggcaccagctacaatctcagtaatttcctgagtaatcgctgcctgacgagccctattgtattggattgtcaaatcgttaatgacattcttagcattatccgttgctgtctgcatggctgtcatacctgctgcattttcagcagttttggcatccaaaatcgctccataaatagttgattctgcatattgagtcaagagttgttccaaaataacctcacggtttggttccaactcaaaggtagctgtataaccatctgcttcattgtggtccaaatcttctacaggaagcatctgttgtacacgcacctgactggtcaaactattgacatggtggttataacaaacatacaactcatcaaagagttcattcttgtacatttcaacagacttagaaatgattttttgaacctcttcaaaacttgggttgtctgctaaacctcgcaattcaaagacaggattgataccacgggcacggaagaaatcagctcccatactaccaatggcaataatctcatactcgtcttttgagtcatgatcctgttcaatcatccccatcacagccttcaaaatactggaattataagaaccttttagtccactgtcagaggtaatgacaatataaccagatttttgaactggacgacgaatcagcattggattgcttgtatctgaagccatcaactctccacgcaagaggtccgttgtaatctgacgaaccttgctagcgtagatttgaaaggattgcgctaattgctctgatttggctaatttagaagccgaaaccatctgcatggcaccggtgatttgactggttttcttagttgatgcaatttttgatttgatttcattgagagaacctgccattattcactcctttacttaaagacagactggtctttgaaagcttggatagcagcattcaattcatctgtatcaggaagatcttttgttgtacgaataacatccaaaagaccatcgtagtgcaaatcaaaatatgcgtacagttcttcttcaaatgccaaaatatcatcgattggcactgaatccaagaagccatttgtcaaagcatacaaaatcaaaacctgtttttcaactggaagcggcttatgcaatggttgtttcaacacttccacagtccgacgaccacggttgagtttagcctgagttgctgcatccaaatccgaaccaaattgagtaaaggcttctaattcacgataagaagctaagtcgatacgaagggtacctgcaacctttttcatggccttaatctgtgcagagccacctacacgtgatacagaagaacccgcatcaatggctggacggataccagagttgaataaatcgtccttcaagaagatttgtccgtccgtgatagaaatcacgttggtcgcgatgtaagctgaaatatctcccgcctgtgtttcgataaatggtagagctgtaatggagccaccgcccaattcatctgaaacctttgctgaacgctcaagcaaacgactgtgcaagtagaatacatcccctggataggcttcacgacccggaggacgacgaagcaagagagataattcacggtaagctaccgcttgtttcgacaaatcatcgtaaacaatcaagacgtgtttgccttcatacatgaactcttctgccatcgcaacaccagcataaggagccaagaaaagcaatggagacggttgtgaagcagatgcagttactacgattgtgtaatccaaagcaccatattgacgaagggtttcaacctgagtacgaacagttgactctttctgaccgatagccacatagatacaaatcatgtcttggcctttttggttgagaatagcatcaatagctacagatgtcttccctgtctgacggtcaccaataatcaattcacgctgaccacgaccaatcggaaccaaagcgtcaatcgccttgagaccagtttgaagcggttcattaaccgacttacgttgcataacacctggtgctggatattcaatcggacgagtcttactagtacgaatctcaccaagaccatccacaggttgaccaagtgggttgatgacacgaccaatcaaagccgaaccaactggtacttccataattttaccagtacgacgaacaactgacccttcacgaatatcggtaaattgtccgagaatgataataccaacatcgttggtttctaagttttgtgccataccaatggtgccattttcaaataccaaaagctctccactcatggcattgtcaagaccttgcgcacgggcgataccgtcaccgatataggttacgacaccagtctctgtgtagtcaaagtcaggctgaaagccttcaatttgttgttttagtaaagcgctaatttcttgtgcattaatcaaaagaacaccactttctattttttaaagtttttttctaatgtccttcaactgtgtccgaacgcttgcatcgattaccttatggttaaccgttacaataaaaccaccgaggagactttgatcaagttcttccgtgatattgcgtacacgcaaggaaaatcgttgttctaccaagtgacggagacgctctttttgagcttctgtcaacggatagactgaaaccacacgggcttcaaattcatttttaaatttactgatttgtaattggacacgctcaagggtttcaagaagcaagtctgcatgaccatcacgaataacatcttcaatcaagtcattgatttgccagaaactagattgacgtaccgtccttacaaagtcagccttttcttctctcgatactgtcgctgacagcaagattcgattcagcttactatcatgaatgatggaaatcaagtcagaaatctggtcatacatatcccaaatatctgcatgatcactgactttttcaacaaatgatagagcatatttttgcacgatggcattttctctagcgttcatctacttgtctcctagtttgtccaaataacggtcaatcaagttactatgagcttgttggtccaaatcttccaaaataattttgcttgcaagatcaactgccaattcagcaacttgaacacgcaagttttcttgtgcttcacgtttttcagcttcaatttccaattgagctttttgcttcaatccttgaatttcaacatctgcttgctcaagaatacgttttttctctagttttgcgcgttcaaccgcgtcttgaataatcttttgactttcaatacgtccctgtaccaactcatcttcacgttgttgaacaaggtttgctgctgctgttaatttttcttctgcagcatcaatatcgttcgcaatcttattggcacgttcttcaaaaatacctgtaattttatcccatgcaaaaacacgaataagaataataagtactgcaaatgaggctgttaccaagataaagtttccaagaatggtactagattgcattgtaatagttgttgccatagttgtctttccctttcctattcactctcactactgatttttttatttaagtacatagataccaacatgataaatacatatccctgcaagcatgaaatgaatacagaaaatgctgtccaaacaacgttcagagcaaaggcaattggatatgcaagtgcactttgttgagataattgtagaagaagagagacaagcacttcaccagcataaatgttaccgtacagacgaagagcaagcgacacaaggttggtcacttcttccaaaatgttcattggagccatagcccagggtgtcacaaaagatttgaggtatgccttgaaaccgcgacgacgaataccctcaacatgacaaaatactgttgcaattgttgccaaaccgaaatcgtaagccatattggctgttggagaagtccacaaattatgtccttctgctgtttccaatttggtcatcaaacctagattattggcaaccaaaagaaaagtaaagactgtaaagaagaacaaggaataccgctttgcttccgcatcgccaagattcccttttgtaaaattgatggtcaattcgtaaacatactccaaaacattctgttttccttttggcttgagctccatccgacgactagcccaaaaaactcgtaagaaaataatggaaatggtaatgacagaaaccaataccatggtcaggtcaaaggttacgggaccaagggtaagggttggacttaaatgttcttccaatggaggttccccccttttctatttctctattttctactattttaagacaaatgtcatagccaaggttacgaagaaagttccctcgataaaggcaacacccaaaaatacaccagccatcaatttactttgcatttctggttgacgtgcagtcgaactaaggtatgaagccaccaacagtccctcaccgatacttacaccaagacaggccaatccaagggccaatgcgcctaaactcataacgaattctccttttaaaatttaataccatgtaaggatactcctaaaacatctatttgtcaagaaaataccgccattgtaagcgtttaattcgtttttgtaaaataaaaagaaaagagtatttcatcttttcttcctatttaatagcttcatcaatatggtctgtttcttcaatgaatcgtttggccatatcttctcgattcatctgatcagtatcaagagtgattgcatggtcagaaaccagatctgtatctgcgaaaaactctatatggtttgataggttgtacagacgtacaggggcttccccaccaaactctccatctagattgagcagtagacggttatctgggttcagattttcgatggataggctcttggtttttatgtattcaactaaatcactctcaatgtgtttgccaccatctaagacttgacgaatcagatgtagaatttcaaatagattccctgttttaaccatcaataaggtaaaattaccatcatctaacttagcatcgggaacgatctgttcaaaacctccaattgaattggttaaggcaacaaaaatcattgaaaccgagccttcaaacacgccctcatcatgctctacacgaacaggtgtaaattgtacttgtggcaggagttctgctccttttactacataggccaaatagccaaacatggtcttaagttgactgggaacactgtaggtcaactccgtaagtgtacctgccgcagcaatgttgataaaataatgttcttgatgaaaaccatttttttgatttttggctaaaccaatatccattaaaattgtctgctgcttaccaataaccttagctgcttctacaggatttcccctaggcacttttaaagcacgcgcatagtcattggtggtgccagtcggtatgatggccatctgcggacgtttttcaagtggagcaattccattgacgacttcattgattgttccatctccaccagccgcgataatcaagtcaaagcctgcaagcgccgcacgtgtagcttcattctttgcagagtctttctcagcagttgtttggaaagctgaagtctcataaccgtagccttccaaaatttccaatacttcggccacatttttcttcatgatttcttgacctgaggtcggattatatattagtctagcacgttttctttcttccatcgttttacctttacaagctctctaaccaagcctcatcttttatttcaatacctagctcctgtgctttggtcaatttactgcctgcatctgttccggcaaccacaagattagtttttttagaaacagatcccgctacatttgcccctaaagcttctaatttggctttggcttcgtttcgtttcattcgctccaatttaccagtcagtacaactgtcatacccgatagcgcagcattttcatctactacttggccgagataggttaagtttaccttagcttccttaagttcggctaaaagttgttgcgcaccctcactagcaaaaaaagttgtcaaagacttagcaataacctgaccaagaccttctagcgaagcaattgcttcttgatcagcaaatgctagagtttctaaatcaccaaatttttctactaaaatcttacttgccttactacctacatggcgaatacctagtccaaataggaggcattctgctgagttactcttagaagtttgaatggcttgatagagcttgttagctgatttttctttgaaaccttccaaggtcaataggtcatcaacagttaatttataaatatcagcaacatcgtgtaccaagcctgctccaaagagtttttcaacgattgaagaccctagccctgcgatattcatagcatcccgacttgcaaaatgttccaacttactcatcagctggctaggacaaatagggttgatacagcggagggcaacttcgtcctcatagtgttgtaggtcgctctgacaagacggacaatgactaggaatgggcatgatttcttgctcttttcgatacttgtccaccactttcagaactgctggaataatatctcccgccttataaacaatgaccgtatcgccaatacgaatatctttttcggcgatataatctacgttatgcaaagttgctcgactgacagtcgttcctgccagttgaacaggactaagattggccgttggtgtcacaacacctgttcggccaacagtccaatcaaccgacaagatttctgcttctttttcctcagctggaaacttgtaagctactgcccatcgtggcgctttaactgtaaatcctagttcttcttgtatagctaaatcatttaccttgatgacaacaccatctatctcatagggtaaatcatctctacgctctgctattttttcaataaaatcccacgtgtcatcaatcgactccgccaagcaatattcgtggttggtcacaaatcccagagcatccagtttctccagtacttgtgactgactagtcgcttcagatggactagcctcttggtagaggaaagtagcgagaccacgctgggccaccactcccgtatcaagctggcggagggtccctgctgctgcattacgcggattaacaaattcagcttcaccagcctcctgacgctgtttgttaacacggtcaaaggaagcttttggcatataacactcacctcggacagtgatgtccacagcttcgggtaaggtcaaaggaacatcagccactcgtttgagattttctgtgatattttcaccgacactaccgtcaccacgtgtagcacccacgactaaattacccgcttcataggtcagggaaatagacagaccatcaatcttcaattcacagatatacgttgcttgaggaaattccttgcgaactcgctggtcaaaagcttctaactcttcacgagaaaaggcatcctgcaaactaaaaagaggataaacatgactatatttttcaaatccgtctagcatctttcccccgacccgatgggtaggactatctggtaaaatcagttctggatgagccgtttctagctctactaattcacgataaagcgtatcatattctgcatctgatacgctaggttggtccaattgataatactctttagcgtattgattgagcacgctaactaattctgatattcttgttttcataagaatattatatcatgatttgagggtgcgaactatatttgcgcttcaataaaaacagattcctttagataatttttagtaaaaaatgtataatgtttatataaaatttttggaggtgccctatggctgtaacttataaacgacaagatgatttagaaaagatgctggaagaatttgcttcatttgaaaaattggaagaaattgagtatccagatccaaaatcaaaagaacattccgagaaaaacaacttgaatcaggataaaaaataatatgcttggtcttgatcaattacctacctccgtcctacaggcgggggctattttcctatctatcatgattgaagccttgccctttgtcttgattggagctattatttcaggttttatcgatgtgtttataacaccagataaggttcgtaaactcttacctaaaaacaagtttcttgccattctatttggaacctttatcggcttcatttttccgtcttgcgaatgtggtattgtccctattgtcaatcggctattagagaaaaaagtgccgagttatactgctgttccctttttagtaacggcgcctgtgattaatcctatcgtcctttttgcaacctttaccgcttttggaaattccctacttttcgcactctatagagccctaggagccatcattgtatccctagtattgggaatcattcttggttttttcgtaaaaggaccaattcttaaaggaagcaagtttgaccatcaccagcatgattattcagataaaaccagctggcaaaaagttggcttcgcacttattcatgccattgatgaattttttgatacgggacgttacctagtctttggttgtctatttgccagtctcgtacaagtctatattccaaccgctgtcctgactaccatcggtcacagtccattaacagctattttactgatgatgttgctggcctttcttctttccctatgttccgaagccgatgcctttattggtgcatcactactatccagcttcggattcgccccagtaatggctttcttagttatcggacccatggtggatgttaaaaacttgctcatgatgaaacattatttcaaagggaaatttatagtcggttttatcattactatcactctcgttattttgggatatagtctgatacttggaggtgtagtatgattcgttttttaattcttgcaggttactttgaaatgaccatgtatctttatatctctggaaaattagaccaatacattaatctgcactatagctatctagcctatctatccatggttttatctttcatacttgccatcgtacaattgtatgtctgggtaaaagaaattcgagtacatagccatttaaaaagcaaaattgccaaactatcaagcattggactattgctcattcctcttgctatagcctggctctttcctacggtaagcctggattcaacaactgttgctgccaagggctatcatttcccactagcaacagaaaacgatactaatacacaaaaccaagaaggggcgactgttcagtatctcaagcctgatacttctatttattttacaaaatctgcctatcaaaaccagatgcgtgaaattgctgatagatacttggctgaagaaaccattgtcgttactaatgaaaactatatggaagtgatggaagcaatctacgactatcctacggaattttcaggaaaaacgattgaaatgattggatttgtctacaatgaccctgacaatagccagcaatttttccttttccgctttggtattattcactgcattgctgattctggggtatatggcttactctctacgggggctaccacagaatttcctaacaatacttgggtaaaagccagaggaacaatcaaggtttcctaccacacatcgttgaaacaaaatctcccaacacttgaattacaatcgatggttcagattgagcagccagattctccgtatgtctaccgtgttttctaataattccaactaaaaaagtgaattttctgacaatttgtggtatactattaatgatattcaacagataggaatgaaattatgtcatcacatgtattgtttacaatttttggtgctagtggcgaccttgccaaacgcaaactctatccatccctcttccgtctttataaggcaggccatatccgagaaaattttgcagtaattggtacagctcgcagaccctggaccaaggaattttttgagcaaaccgtcattgaatcactaggtgatctgcctgacacaccacgtcaagctcatgaatttgcaaatcatttctactaccaaagccacgatgtcaatgacacggaacattatgtagctcttcgtaaattgcaggacgacttgtgtgaaaaatacaatacccagcacaacaaggtcttcttcctctctatggcacctgaatttttcggaaccattgccaaacacctcaaatctgagcaaatcgttgatggacaaggttttgaacgcttgataattgaaaaacctttcggaactagccttgctacagctaccaaactcaatgatgaattggcagcagccttcaatgaagaccaaatctaccgtatcgaccattacctaggcaaggaaatggtgcaaaatatctttgcggttcgctttgccaatatcatttttgagcatatttggaaccgcgattacatcgataacgtccaaattacatttgctgaagcgattggtgttgaggatcgtggaggctactacgatcattctggcgccttaaaagacatggtgcaaaaccatgcccttcaagttctttcccttctagcaatggataagccagccagcttcaaggaggaagatgtccgcgctgaaaagattaaggtcttccaacaccttcgtcagccttctgatgaggacctcaaacgcaacttcatccgtggtcaatatgcagcaggttccattgacggaaaagactacgttagctacttggatgaaccaaatattgccgaaggttctcagacagaaacctttgcaggaggtgtcttcttcgttgatactgaccgtttccgtgatgtacctttcttcttccgtacaggtaaacgtctgacagaaaagggcacgcgcgtgaccatcaccttcaagcatgcggaagatatttttggtcaaccttccgaagccaatgtattgaccatcttcatccaaccaactgaaggcttcatgctctctatcaacggtaaggaagttggttcccattttgctcttactcctgccaaactcaacttccgccacaatgcaactgctcttggaaattcacccgaagcctacgaaaaactctttttcgatgtcctaaatggtgattctactaactttagccattgggaagaagtgaaagcaagctggagcttgattgaccgcattgttgatttgtgggcaagcaaccaagtcccactccacacctatccagctggaactatgggacctgaggcagcctttgatttgctagaaagctacagttgcaagtgggtttggacacctgatgtctggtatcgtgaacgtggtttattgaaatagtcatttagtttagctttgattacttcgttaactcgctttgccgtactccacgaaagtgacttgcttcgcatgtcttatttccaacctagaacagcctctaggctgttctagcaacctgcacctcgttgccttgtactaaaagcaaactaaacgactacatataaaaactggagcaatccagtttttttgggagatatttatgactgaaatgaacatcattctcacccaacttgaagtagccagccatgctggcaccctcaagcgttatgaaaaaattggcgaaactaagccctactacggagttccaatgggagctatttctggtatcgccaaggcctataaaaatcgactggacttatttgccccactctggcaaacaggtgtcctagaagcacaatatttagctattcaagttgccaaggctaaacctaaccaacttccccaagctgacctagagaattgcctcaatgaacaaatttcggtcaatgtcctcgataaattggcttccattatcctcagcaaacgcaaggatagcaaagactgggaagaatacttactcatccaagaccaggctatttttcaacgattaggttggttccttcgtgccaaatactttgctggaagaactgcctcaaatcaagaaatcgaagaatctctagaccatattcgccagcatttgcaaaccgctgacccgcttgtccaatggaccatgaaccaatgcttagtggagattgcagttacctatcctgactacctggaacaaggtcttgcaattggtcaggaattggccgtctatgcgaacatgaaagttccaaaaggctgcacttctgcctatgcaccagactggatagaagcgttgttgaggaggaaataagatgcaacataaaggaactcagattttagaaacagaacgtctaattttacgcccttttcaagcaagcgatgttgaatcagttttccaaaactggacttcagatgaaaaggttaccacctatctgacctggccaacgcatcagacactccaagatactgaagactatgtccagttctgtcttcaatcctattcacaggaaaaaacatacaggtgggtaattgagctcaaagaaaatcagcaacccattggagatatttccgttgtcagccttgatgaaagagttcaagctgccgaattaggttgggtgttgggcagtaaatggtgggggcaaagttatatggccgaagctcttgaagctgttaatcactatttattggaggaagtgggctgtttacggattacagctgttcacgatagtgaaaatcgtccttctggtcgtgtcatggaaaaagtcggtatgacctatgaaggaactctccgccaagccgctcgaaacaatcggggtattgtggatattgccatttactcactgctgcatacagatagaaaaagtcgctagttcattgaactaacgacttttttctataccaatccttccaatagcccacgcatgaattcttcggatttgaattcaccgatgtcatcgattttctcaccgaaaccaattagcttaactggtatatccagttcctgacggatggcaagaacgacaccacccttggctgtaccgtctagcttggtcaagactagcccagtcaatggagtaatttttgcaaattccttggcttgactgagggcgttttgacctgtggaggcatccagtgctaagagggtttcatgcggtgcatcaggtagggtccgtttgatgatgcgaccgattttttccagctctgccatgaggttttctttattttgcaagcgacctgctgtatcaatcatgagaatatccacgccttctgccacggcacgttttaccccatcaaaaaccacactagctgggtctgacttttcaggtcctgtgactactggcacatcgacacggcgaccccactcgaccagctgggctaccgcacccgcacggaaggtgtccgctgcgaccaacatgaccttcttgccagcttgcttgtacttgtaggctaacttaccgatagacgtcgtcttcccaacaccgttgacaccgacaaagagcatgactgtcaaatcatcttggaaattgatttgctcactgaattgaccgtctttttcgtaaatatccaccaatttttcgatgataacacgacggagttcatctatcttcttggcattttgtagcttggcttcatagcggagctcctctgtcagcgtagaagcaacttgcacacctacgtctgacaaaatcagcatttcttccaactcttcgaaaaattcttcatcaaccgaacggaaattggcaaagaattcattgagccttgccccaaatcctgtacgcgtctttttcaaggtacgctggtacttgtcctgttcactttcttgccctactggagcaacttcctcaacaggctcttccttgaccttggtttgaatagcagggtcaaagccttgttcctgcgcttccttcactcgagccgcagcggcttctttggctgcataatattgagccatcatgtctaaggtccgttgtttctgagcttcttgttcggctgtcaattcagtctctgctacttcagactggaacttttccatttcttgagtagctgactcaacttcagtagttactgtatcttcgctagaagccgactgctccctttccacttcttcaacaagagcgacttgctcctcttgttttttttgtccaaataatcgatcaaataatcccatactagtcctcattcaatacatagtgctcgatgacccaagcaatgccatcttcatcattgttttttggcaggacaaggttggccgcagacttgatttcatcagtcgcattagccatggcaacacccagaccagcccattcaatcatcgaaagatcatttccttcatcgccacaggccataacttctgactgatcaatccccagatgtccaatcaacttagccaaaccatttgctttatgaacaccttttggactccattcgagcagaatatcacgcgatttgaaaatctcgaaacgctcgtgaagttccgcaggaatttttggaatttgtccatccaaaaagtctgctgccacagctgaaactgccttattgtagacaaaatcttctggcatttcctcatcgcttgccacaattttattaagcaatggattacaagttagataaagtgattcatgggctgatggtagagaatagacatcgccaccatagagaacatccagaggaaggtccaagtcatttgtcacacgacggatggtgcgcacatcttcaatggtgaagccaaccttatccaaaactcgacctgtattttcctggactagaccaccgttaaatgtaatcgaatattgattctcccctaacagatctagttcttctagaaaagtaccgatagcttgtaaaggacgccctgttgtcagaactacataaactccacgctcacgcgctgcctgcaaggcctttttattagcttctgaaatccgtttgtccgatgtcagaagtgttccatctaaatccaatgcaatcaacttaattgccatttacttcctcctctaaataggctaatactgctccatcattgcaatgaccaatcatccaatctgcctgggccttcacttcctctcttgcattttctgtcgcaagagccagaccagcaaagtcaaacatatccaaatcattttgattatcaccaaatgccactacatcctgacgggtaattccaaaatgagcacagagatgactcaatccaactgatttatttgaaccatttggaattatatcaatattgtcaaaaccagttgtcatggccgttacaccttcaaatgtatcatttaaccatcgtctagcatcgtccatttcctcaggagaaaatttggcattgatttttataatctcttctcgaacttcttcaaatgtgtctaccaatcgaaaatgtgcgtaataattcgtcatcgcttctaaaaactgaggctcagcattttttaataaataaaagttttcgaggccagacagcaccatggaacgactgctaccaaagggacctgcatcaatacctgcgataatcggcagataaatttcaggactaattggatcatccataaagatagtctgcccctgatattcaacgattgaaccattttcagctacaaacccgatttcatctacaaaatcttcaaaaacaagtttcaggctttgcatagatcgcccacttgctgccacaaataaataacctttttctttgaactgattcagtatacgacgaaaccgttccttatcaaaactatggtcttctcgtaaaaaggtaccatccatatcactggcgtaaattttgttaatcataatttctccacatctttcagcttaacggaaacaatcttggacacgccagattcctgcatggtcaccccatacatggcatccgctgccgccatggtccctttacggtgggtcacgacgataaactgactctccttatcaaaacggttgaggtagtcgccaaaacgtttgacattcgcctcatccaaggctgcctccacctcatcgagaattacaaaaggaatggtcttaacacggataatggaaaatagcagagcgagggccgaaagggctttttcgccacctgacataagattgagagattgaattttcttacccggaggttgaacagaaatctccacacccgcagtcaataggtcaccttctgtcaaaatcaaatccgctgaaccaccgccaaacatttgtttgaatgtctgcttaaagctttcacgaatagcttcaaaagtaaccttgaagcgctctttgacttcatcatccatctcgtggatagtatctagtagtaaatcacgcgccgacaaaatatctgtccgttgctcattgaggaaggtcagacggttattgacctcgtcatactgctcaatagcatccaaattgactggacccaaagcacgaatagctctttctaggtctttgaggctttgttcagcaactgcaagattctcaacttccttggcctgagactgagcagcttcaaaactcaatttgaaatgctcggtcaaattaccaagtaaagtccgtaatttatcgcccgcttgctcacaatccgcctctaacttagcctgcttacggatcaaatcatcattcttagtccgagcttgttgcaatctttcttccaagtcttcaaactgcccatcaatatcttccaactcaaactttaagcgaattagaatctgattggtctggttttgcttatcagatgcggcctgcaattgttcttcaagaatctcaatgctagtatcttcaagagcttctaacttctggtcaatcatatcctctaaaagagaaatttccttatctgcaaccactttttcttcttgcaaacgtctcagatctgtctgttcaaaacgaagttggctagtcagttcagcttgttccaaagttagttgacccttctgagtctgtagtttctgcaagctttcttgaatactgtcgcgattatcacggacttgattgatttgttgatccaaggctagttttttctcattcaaggcttggacatttacttcttccttagcagcagcctcttctagctcagtcaaaatggtcggactaacctgactcatttgcaggtcatactgggctgatagctgagccagtctattttctgcctgttcctgatgaatccttgcgctctgctggttcaatctagcttcttccccctccgccttaatcgtttccaaggcttctctggtttggtctaagctagttttcttagctgcaaccaagctttcttgctcctgcaactggctagacagctctgctatttctcctaaaagagcatccagttctggtttgataaaggtcgtgctgttatttcgattgctaccaccagcaaaggctccaccaggacggatttccgctccatccatggtcaccatacgcacttgaaacttggtcgcacgcgccgcctggttggcatggtcaatgctatcaaaaatcgcaatagtgcctagcaaattttggaaaatcgcatctaaatttggctgataagtcaccaaatcacttgcaagccccaagaatccttctgaagattctagtaaagagacttgctgtccagaaagctgacgtggcttgatagttgttagaggtaagaaggttgcccgtccttgccgtttttctttcaaaaatgcgatagctcgtttagcagtcgcttcatcttcaacgatgacgttttgactagcaccgccaagagcaatttccaaagccgtttggtaacgagtatcaaaggtcaattgttcactgactgctccaataattcctcctaagcttggtgccgcctgtaagacagccttaacccccgcgtagaaattggagtgattttttaaaatagcttctaaactagactgacgagcctgcttgcctttcaactgatccagcaaatcaaacaagcgaccttgctcagcctgataagcagtctggacttgatccaattctgtttttttggtctgatagctctcaagcaactggcgtaacacgtgatcagcttcttctaaacttttccgactcttatcaagtacttcttgagctgtttgtttttccgtctgcaagcgtgccaagtcttcagatttactctctgaaagactgatttgattggcaatatcctgctgaatcttggtcagactgtttgaagcttctgcctcttcctgcatcagagcaacatactgttcacgcagatgatctaaaacctgatcaggatcttctgaaaagtaggaaatttctttgtctaccgcagcaatatcgtctttcaagctagacaaggaactatctaattgcgcaagcgtttcttgcttttgctcaatctgttctgccaactgctctcgtctagtcaacaagttttccaagcgcgcctgcgcttcttgatgacttgattcgttttgactagattccagtttatggacctcaatttttcgctccaaatcactgattaacttggtcaaatccaacagaactgcctgttcacgctccaattgttctgaaaggcggtggcgcttctctttcaagttcagattttcttgctccagctcagaacgctgtttgtagtagctagtcaattcagttttgacagactctagttcggcctctttttccgataacttttccttaccaagcgacaactgagccaccaaaacatttaagtataattccttacgttgaccatctaattctagaaatttcttagcagtttgtgcctgtttctctaatggtttgacctgattatctaattcgtagataatatcgtccaagcggtccaagttgtcctgggcctgtgccaacttactttctgtttcttttttacgcgtcttgtattttaagacccctgccgcctcttcaaaaatagcacggcgttcctcaggcttggaattgaaaattgcttcaacccgcccttgtgaaatgatagagaaagaatcacgtcccaagcccgtatccatgaaaagatcatgaatatcccgtagacgaaccttttgcccatcaatcaagtactcactatcaccagatcgataaatgtggcgttctaccttgatttctttctgtttattggcgataaaacctgtgctattatccaaggtcacgacaaccgaggcatagttaagagccttgcgactttctgttcccgaaaagatgacgtctggcatcttgcctccacgtaggcttttagcagacgactctcccaaggcccaacgtagactttctgtaatattggacttgccagaaccattcggtcctacaacagcagtcactccacgatcaaagactaccttagtcttatccgcaaaggacttaaagccctgcatttcaattgattttagatacatacctatcctctagcctccacagcatttttggcggcggcttgttcagctaatttcttagagcgaccacgaccacgaccaatcacacgctgatcagcagatacctccacttcaaaggtcttatcatgggcaggtccagactcagctattacttgatacgaaatagcaatctcaccattgacctgcaaaatttcctgcaaagcagtcttatagtcggtcacgcgctcaaaattccctttttctaaacgaggaatcatgaccttatggataaattcctccacggtcttttcccctttgtccaatagcagagctcctaagaacgcctcgaaagcatctcctaaaatagtatcgcgatttcgccctccagacttctcttcccccttaccaagacgaagaaaccgatcaaaaccacaagcacgtgaaaaaccagccaaagactcctcacgtacaaaggtcgaacgcaacttggacatctcaccttcgggtctatcaggatatttttgataaagatatttggaaatcatcaactggagaacagcgtctcctaaaaattccaagcgctcattatgtgaaatttttagaaggcgatgctcattggcataagaagtatgggtaaaagccgtttctaataaattcaaatccgaaaaatcaatcccaaaatcagccaataattttgcatgtaaatctttcatctatatgctcctttctaacttaaacgaaatagatagtttacatttactccgtcctaacattataccatattttccactggacttctcttgtcaactaagtttcagccagcacctctccacatctttttgcaaacatttacatattcatcagatttcgataaaatagaagaaaaaagaagaacgttagcatgcaaaataagacaaaaccactcaatacatcactgctctccctcatccagttcatcggagccattctcgttatcgccctccattgccgcaggttatttgaaacagaccagctccacttcatccaaaaatcaatctttagtcgcatggtcgttccctacttcatggtcacagccagcttcttcctccgacgcaactaccccagcctctccaaacaatacctaatccgctacagcaagcagtacctgacctggtccgtcctctacctacccttctacctcttctacctaaacctccaagaaatccccctactccactaccccctcgcactcctagtcggactgacctacacaggcaccagctaccaactctggtacatgcccgccttcctgctaggtcttgtccttgtccactattctttaaggaaatggggctggcgcatcacagcttgtctagcctgccttctctatcttctaggctcagtcgaaacctactcctcctacctggcagaatcgattttcctgaccgcatttgacagctacaaaaccttctttttcaccagccgcaacggcctcttctacgcaccgatttttctcctgacaggcttttatctagccgacaaactcaatcaccccattttccaataccgacaaaaaaacaaactacttgtctgcacagcccttttagcttttgaagccactgtcatctatctcaaacagggctacgacaagaactttctatttagcctgattccattcacagcctatctagtcgcctggaccctaaccacagatctattccgccagaaaaaattccaatttctaaaagaatacgccagctattattattttatccatgttatcccagtcgaaatcagctttttcttcctagaaaatcattccctgactataatacagcaaggctggctggttttctttatcaccatcatcacttgccaactgctcagctggttaatcattaatactcaatgaaaatcaaaaacagactagctccaacagtctggcaatagactgttggaggtcggaaattagacgaacttggttcgtgaccgtaagatgcagatagaacactgttccttattatatttcaagggaacaggctgaaaagatccactggaccttttcactcatcaaatcaagtcaacaacgtctgattttgattttcgaagggtataagcacaaaagaaccttgtaagatctaacttacaaggctttttttacaaatcaaaatcctctgtcaatttggcaatgacctcttggagaagttcacgattgacactgtatttgacatcgctattttttgtattgaagagaagtaagtcaccgttaatcagcttttgagtgtggaaagacactgccgcccctgtaatagccagtcgttctgcaatgtccttgctcttggcatgaggcttggtcagctcaaccaagacctgatagcgcgtactatcgctgatgactttaagagccgttgtcaaatcatccagatccagctcgtcatttgacagcataatctgatcaattcgacaggaagctaaaagagcgactttcatatagtcaaattcttcgttgccataataagcaaaccaataattccacggactgagaacgaagaattgagcattttcaacactcaaagcatccaagccagtcatggacaactgtttggagtctcgatagagtttctcaatgtcaaaatccctagcaaaggcttcccgctcaactcttgcttgctcaaaatagggctggtagattggaagcatcttatccaagagatggacagaccgctcaactgtttccaggggattgcggatagccagtgaccagtaccacttatctgccggctttttatccgttttttccaaaagttccatgaggctgagggtcttctcacgatgtccgtcattttcagatgccaacatggttcgcatggcatcttctacttcttcttgagacagctttaaaatcaattgacaagcttcctcaactgtctttggatcctgcccatcattcaagatatagaaataaagactatgcaaaatgttaaaaatatatccccagacaaagacttgattgacttcttgacgaaaatctgccaacttttcttcaatctcatcacgaatgtccaaggtatctttgagaatgcctttttctttctgtgaaaaatccgcctcaatcggttcctcacgctccttgacaattaaaggaataaagaatttttcgacaatctcgcttctataatctcggtaatctaatttcatacgcatactttctaagctttaacaactacttcatttttagacttacgccccacaagaatagtatagcttactagtcctacagaaagcaagaggaagatgagagaaatacttgtcgcagaaagcactgtcaccattagggcaactaaagcttgacctgctaccataccaatctggcagaaagcatcaatccctccaccgactgtcgccaatttatcttcaggcagttcatttaagaccaaggcattcattttcggattgaagacacccaaagtcatagctgtcacaaaaataatcgtcaataccacataaatattgtggagaaagaaacctgagaaaatcaagactggcatcaatgtagagaatttgaggagattgattaagctgacatttttgaacaaagccataccgatacttgaccccaagatactaccaactgagaagaaaatggaaatcaaagcaacggttgttcctgcattgacaatcacaaagtctgagaactccttcatatttagaataactaatggtgaaagtgcggtaaaaatggcattcaggctggcaatggtcacaattgacgctttgagaactggaatattctgaacagcttggtaggattctttgagactgttacgcatgcccttgataatacctgcttctgtttctgtttgctcagcttcttggattggattttccttcagtagcttggcaagagctggacggagggttgccatgatagcaagactgaccaagaaggtccctgcattgaagaaggcgagattctggtaagacataaatccgatcaggatagcaccgctagcttggaaggcaatttgcaaaagacttttcaccgtcatcttaaaagccatagctgtttcacggtcttcagcagccacaacccgcaagctgactggcatatagagaccgttttcgtattgaccagcaaggtcagacaggaagttgatgacgcagaccaccgccacaacccagagggctggtgcaaatcccatcaagaagccaacaaaggcatagagaccgacacgaaccaccagagttgcaagaatggtatccaatttgtttttggtcttgtctgcccaaatcccgataaagaggcctgccaaaatcggcaaggtttcagatgcggtaatcatagccagggcaaacttggtatctggtaagagtaaaacatagttcatcaaagccagatagtaaagcgtatctccaaagttggaaatcaagtctgccacaaagctagatagaaataatttattgtgaatcaaccttttcataaacgtctccttaaacatcaattaaatatttgtttaatgttattttacactttatttcaataaagtcaatatttaattttataaaaattaatttttttaaacggtaaattctcaaagtaagttctagttcccgtccttccagaagttactctgagaaaactgcataacatcaacagaatttagtctcagactaagttctgtttttgactaaaaatgttgataatagtgagttttagggttgaaaatgttgaaaaaagagtacactaaagttactggctctgagacgtctcaaagtaagttctagctatctggaattttggatggaacaagttcctttctattttgaaattattttttgataaaaactagcgattacttatccaataatcgaggtgattgaatgacgttctcagggtcaattttagagattcccaaaagtgttgccaattcctcaccgtaggtaaatgtaaagagttcataggctgattttccgttgaaagaagctcgtttgacgctgttgatatgcgaacaaaccaggttgatgtcctcctgtgtcaagttgtcaaaagaacttcttttaggaagaatatctctgataagtgtgtgattcttctcaattctccccttctggtcagaacgattggggtcacagaagaatagcttagattctccgcgaacatccatttcgatatcgtccactctagcgaattcaccgccattatcggtcagaatgacaggaaatatttcgcaaaagtccatctctttctgatgcaggtcattcttgatagcgtagagatgtttagcgacctcattagctgttttattatcaagtaattgagcgaagataaagttacagaaggagaggttaaaggtgagaagtacctttccgccgatccgtccagtaacggtgtccatttccagccaatagctgattcctttctctgtgagaaagcgttggaagtcctcgtaagaccgtccttctttggcgattttaggaatgggttgtaggtttctgattctccgctttctgaatttcacgacacgggggaaatcaatgggctttgtggacagatagcctttttcaaggtatcggtagatagaagctctggatgccgacatttcgtttgaggcgatgatgtggttgaggtgttgtcccttttggatggcagcagaaacaatctcatccatgcgatagaattcttccttgtttagtgcaacacctgttctcgaatctgagagcttaacttcataatcaagctgagctctttttgcgtagtagaactgtttctggtatccgcagttgcttctctttttcggacaggcattacaaacgtaaggagtctttttgagtagagggcaggcctcacaattggaggtactagagttctcttttatcaccctatttctccgaacttcttttgaaattgtggacggatcttttcctaacttagctgctatagctgagaagggcttaagttgttcaattcctatttgaatatcattgcgatcagagagagttaagtgtttgtttttcattgtcagttaccaacttgtcccatagtaagttctaccttatttctttgtctcagtctaatttccagtttttaagacagactagaacttactttgggaatttactaatttttttaaacacttgtttaatttttcttctgtctgactttttcttgacaagattagcacagtttgttatagtattgttcgggcacctcttttgagaggtcggagaaaaggctccctagttttagggagctattttttgttttcccagagattaatacacatttggaggacatatttatgaaaaaaatcgcatttgattcaactaaatatttgaatttgcaacgtgaccatattttagagcgtattgcccaatttgaaggcaagctctatatggaatttggcggaaaaatgttggaagatttccacgcagcccgtgttttacctggctatgaaccagataacaaaatcaaactcctccaagagttaaaagaccaagtagaaatcgtcatcgccatcaatgcaagcaacatcgaacattctaaggcacgtggtgacttgggtatttcttatgaccaagaagtcttccgcttgattgacaccttcaatgatattgatatttatgttggttctgtggtcattacccaataccgcaaccaaccagccgcagacgccttccgcaaacagttggaaaaacatggtatcaagtcctatctccactatccaatcaagggttatccttctgatatcgaccacatcatttcaccagaaggtatgggcaaaaatgactacattgaaactagtcgcaatctcgtcgttgtcaccgcacctggacctggttcaggtaaattggcgacctgtatctcccaactttaccacgaccaattgcatggagtaacatcaggctatgccaagtttgaaaccttcccagtgtggaacttaccactccaccatcccgttaacttggcctatgaagcagcaactgccgacctggacgacctcaacatgattgaccccttccatctgcaaacttacggcaaaactgcggtcaactacaaccgtgacatcgaggtcttccctgtcctcaaccgtacctttgaacgtattttgaacaaatcaccatacgcctcaccgacagacatgggcgttaacatggtgggctattccatcgtggacgaagaggctgcgatcgaagcatccaagcaagaaatcatccgccgctactaccagaccttggttgatttcaaagcagagcgggtgagcgagcaagcagttaaaaagattgaactcctcatgaatgaagtcggtgtgacgccagcagatcgtaaggttgttatcgctgcgcgcgaaaaagcagagctgacaactagccctgcccttgctattcagttgccaactggagagattgtaacaggtaagacatccgacctcctcaagccaactgcaactgtccttctcaatgccatcaagcaaattgctaacatcgatgatgaaacacttctcatcgaaccaaactacatccgtccaattcaagaattgaaggcagattatctggataagaccaatacacgactcgatgcaagtgagattcttaacgcccttgccatcactgcacaagatagccctcttgctgcacgtgccatgaaagaattaggccaattaaatggtagcgaagcccactcgactgttatcctatctgatgaagacaagagtgtccttcgtaaattaggcatcaatcttacctttgaccctatctaccaacacaataaattttatcagaaaaactaagcacacaaaaagacttgctccgacaagtctttttgtgaacagtaaaaaagcaaggattcaattccctgcttttttcaacgattaatcgaaatcaacatactctttttgaagttcaagaacttcttctgccgttgcacattctgtcaaggcacggtgagcatattcttccatcttagctgtatcaagtttcttcataaggctacgtgtacgaagtacagatgttgcactcatagagaactcatccaagcccatacctacaagaagtggaacagcttgttgatcaccagccatctcaccacacataccagcccatttaccttctgcgtgtgcagccttgataacattgttaatcaagcgaaggattgatgggttatatggttggtagaggtatgaaacttgttcattcatacggtctgcagccattgtgtactggataaggtcgttcgtaccgattgagaagaagtcaacttctttggcaaattggtctgcaagcattgctgctgcagggatttcaatcatgataccaacttggatatcatccgcaactgctacaccttcagccaacaagtttgctttttcttcatcaaggattgcttttgctgcacggaattcagtcaacaaggcaaccattgggaacatgatacgaagtttaccatgtactgatgaacgaagaagggcacgcaactgagtgcggaacatttggttaccagtctcagagatagagatacgaagggcacggaaaccaaggaatgggttcatttcgtgtggaagatcgaagtaaggaagttccttatcaccaccaatatccattgtacgaaccacaacaggcttgccattcataccttcaagaacagccttgtaagcttcatattgctcgtcttcagttgggaagtcttgtgagtccatatacaagaactctgtacggtaaagaccaactgcttctgcaccgttatcatttacaccttcaacgtcttttggtgtaccaatatttgctgccaattcaaagtgtttgccgtcagctgtaactgtttgagcatctttcaaaagagcccattcagctttttgtttagcataagcttcaccagctgctttaaattctgcaatcacttcttcagaagggttaatcactacgtcacctgtgataccgttaacagccaatacatcaccgtctttaacgatttcagtaatgttatttgtccccaaaacagcagcaatttcaagtgtacgagccatgatagctgagtgacttgtacgaccaccaatgttcgttacgaaagcttttaccaactgtttgtttaattgcgctgtatctgaaggtgtcaagtcatgtgcgataacgattgactcttcgtcgatagttgctgggtttggcaagcgaacaccaagcaagtgtgccaatacacgtttggctacgtcacgaatatctgcggcacgctcttgcatgtatgggttatcttccataccttcaaagatagcgataaacatatccgtaacttctttcaaaccagtctcagcgtttgttttcttcgcacgaattgtttccttaatctgaccaatcatttctggatcagcaagaaccatcaagtgtgcatcaaatacggctgcggcctcttcacctaggctagctactgcgttctcacgaataacagaaagctcgttttgagatgcttctagagcagcatccaaacgagcttcctctgcatttgtatcttcaactgtaacagtttcgaaggacaaatctggctgaacgagtagatatgccttagcaacagcaacaccatctgatgctgcgattcctttaagcatttctgtcatattcttatgccaatccttctttttccattgtttcagtgatagctgcgattgcgtcgtcagcatcagcaccttcagcagagattgttacgtcagcgccttgaccaacaccaagactcataacacccatgatagatttaaggttaacagacttttctttgtagttcaaagtgatgtctgaagcaaatttactagctgtttgcacaagcaaagttgctggacgtgcgtggatacctgtttctgccacaatgtggaagtcttttgaagccatatttggattctcctttatttttacaaaattgcgagttatttgtgataacccttacaaaggacattataccactttttgaaatcattttcaagatttttttacctttctttcatgtttccgtcataaaaagagaggttcattttactttttcttcattaaatagaatctattagaacttctgaaaattgactagtagattgatgagcaacgtccaaaattttagcaaaatcaagcgtaacatttttatttataaaagcgtcttccaaggcctgaataattaaaacagccgcttctttccagccaatatattccaacatcatacaagccgaaagcaagagagaacatggattagccaaatcctttcctgcaatatcaggagcagttccatgtgtcgcttcaaagatagcatgacctgtctgataattaatgttagcacccggtgagatgcctattcctccgacctgagccgcaagagcatctgatgcataatctccatttagatttgtaagagcaaccacctggaagttttccggcgccaataaaatctgctgcagaaagttatccgcaataatgtcatttactaccaaagtcccctctgcaagttctgtagcaaattcttctttcgccaattcataaccccacttgcggaagccaccttctgtaaacttttgaatatttcccttatgaactaaggtcaccatcttcaattgatgttctagggcatattctattgcagagcgaatgaggcgtttactcccttcttccgaaatcggtttgataccaatacttgaagattctggaaaacggatatttaccactcccatttcttcttgcagaaaggaaatgactttggcaacttcatctgaaccagcctcccattcaatacctgcataaatatcttctgtattttcacgaaaaatagtaatatccgtcttttcaggctctttcagcggacttggcactcccttaaaatagcgaatcggacgcacacaggcatacaaatctaattcttgacgaagtgcaacattaagagaacgatgacctttcccaatcggcgtccccaagggacctttgattgcaactaaatgctcacgaattatttccagtgtctcattcggcaaagaagttcccattaattcataagccttttctcctgcaaaaacctccctccactgaatagaacgttgacctgcataggcttttttcactgcagcatcaataactttttgactgactgaccaaatatccctgccaataccatctccttcaatatagggaataacgggacaatctgggacaattaaccgtccctctctcattaggattttttctgccatatttacctctttccaatcgggatgtaaaccaaattcctaccacctaagtaggaagagcgcggacgaatcaatttattatttttccgttgttcctggacatgtgcaatccaccccgccatacggctcattgcaaaaatcaatgtaaaaatatcactatcaatacctagcacatggtaaactgtcgccgaataaaaatctacgtttggaattaaaccttttttggttttaataaagctttctacttcctctgacaatctataaaacgcttcatcgtctgttccgaatgtcaaatcacgcgccatctccttcaaatactcttggcgaggatcaaccgttttatagactcgatggccaaatcccataattttttccttcgaatccagcttcttctgcaaatatctctcggtatcaccactctcacgaatagccaacaacatgtcaaacactcgttcatttgcaccaccatgcaatgagcctttcagagtcccaattgccgtggtgacacaagaatataaatccgttaacgttgatgccgtgacacgcgcagcaaaagtagatgcattcaattcatgatcagcatgaagcaccaaagctttgttaaacgctttgatttgtaaatcactcggctcctcaccattcagcatataaagaaaattcgccgcaaaacccagatcagaccgcggttcaattggaaccaatccgcgtctcaaccgagcaaatgttgcaataatcgtcggaaccttggccataatctgaatagattgttcatacaaagcctctaacgaattctcttcagcgtgtacattatatactccaaggagagatactgtcgaacgcaacacgctcattggatgcaaatgtcgccgtgattgaatcagaatacattgctctaccgcatctgaaatcgcatattcttttcgcaggcttttctcaaaataatttaattcaatctgagttggcaaatgcaggttccacagaagatagatgacttcctcaaaagaagcgttattctccatcagttcagcgatgtcataccctgcataggacaagcggtcattttcaattgcactgattcgcgtatcacaggcaatcgcatcttttaacccattcgtttctgtcatacctttcctcctaatttctttcttactaccataggtaaaatacctccgtggcgataataacgaatatccgcttctgcatcaaaccgcaccagagcttgaaactcctttgtaacatcgtctgtttgcgcatggactgttacaatttgaccaacaccgacatcttctggcaaatcaattgtatagctttcatgtccagtcaagccaagactttctgccgactgaccttctaaaaattgtaaaggaagaacacccatcatcactaagtttgaacggtgaatccgctcaaatgactcagcaagaacagccttcacaccaagtaaacttgaacctttcgctgcccagtcacggcttgaccccatcccatagtctttaccagcaataacaatactaccgacaccaacttccttatatctcatagccgcatcatagataggaagaatctcttcgccaactcttgtccaaccaccaatttttccatctgccagctcattctttatacgaatatttgcaaaagtcccacgtatcatgacttcgtgatttccacgacgacttccataagaattaaaatccttataaacaatgccattctcttcgagataacgagcggctggactcaatcgtgcaatattccctgccggggaaatatgatctgtcgttacagaatcgccaaatttagccaaaacagataaattttccagtggttttatggataaatctgcctgcatgttgtcaaaatagggcggattttgaatataggtagaagatgaattccaattgtaattcttatttatttttgtttcaatcgcattccaagcctgactatctgtaaatacctgttggtattcttccttataaaggtcacgagtcacataacgctcaatgtagtcgtctacctcctcacgacttggcataatgtccgcaaggtagacagcttgttgcttctcatcataccccagcggatcccttgttaaatctacattcatatttcccgcaatagcataggcaactacaatcggtggactcgctaagaaattagcttttaccaacggattaatccgtccttcaaagttacgatttccagataataccgcagaaaccaataaatcttcttccttaatcgcctccgccacttcaggacacagatcacctgagttaccgatacaagttgtacaaccataaccaaccaaattgaaccctaaggtatctagataggtctgcaaacctgattttttcaaatagccagtcactacttttgagcctggtgccaatgacgtcttgaccgtcttagaaactgccaaacctttttctaccgcatttttcgccagtaatcctgccgccaaaaggacatacggattggaggtatttgtacacgaggtaatcgccgcaatagcaacatgacctgtttgaatttgctcatctccttcaacatacttaaccgaggctgttttatctaactctgcttcctccaaaccaaatccacgcacgcctacttcacgtattaaactagcctgaaactctgcttttgcatctgttaattctatcaaatcctgtggtcttttaggaccagaaatagatgggactactgtcgataaatccaattctaaaaccttgctataagacggaaaacgttcagcatcatagaataaataattagccttagcataggcttctgtcaactccacgtgctcctccgaacggttggtcaatctcatataatgtaaagtttctccatcgatcgggaaatagccacaagtcgcaccgtattctggagccatattggaaacagttgctcgatccgctaatgtaagagaagataaacctggtccaaaaaattcgacaaacttcccaactacattttcctgacgtagaagttgagtgaccttaagcgccaaatccgttgcagtggcaaccttaggcaattgcccatctaggcgaacaccaatcacctcaggaacgggaaaataagatgcttcacccaacattgcagcttccgcctcaataccacctacaccccaaccaagtacaccaataccattaatcatggtcgtatgactgtctgtaccaaacatagaatctggataaagcaaaccatccttgttgataataacatcgcttagaaattcaatgtttacctgatggataattcctgttgctggaggcacagcgcgataattttcaaaggaattctctgcccatttcagaaattcatagcgttcattatttctttcgaactctaaggcaatatttttctccagagcatcttcagtcccaaaaaaatcaacttgaacagagtggtcgatgactaaatccactggaatttctgggttaatcaattcagggtttccacctgctttcaccaccgcatcacgcatggaggctaaatctaccacaacaggaacacctgtaaaatcttgcaaaataacacgactaggtttaaaaggaatttcccctttaggagaggcagcctgataatgaagcaactccattatgtgattttttgtaacatccacaccatcttcttttcttaaaagactctctaataaaatacgaatagtatagggaagtgaatgaatatccactttttcttccattgaaatcgactccaatgcataatatgaatattcttcccctttataaaacaagcgctttctctgtgttttttccatattttataacctctttcgacattattgaatagtatagtacaaaaggtaatatatattcaatacatgtataaccataaatgttatattttgtaacatcgtttatttccttcaaaatattatgacatttgtaaaaaagctgatttatactttaccgagagattgttagggttatcaaactaaatagaaacagctatgtaaacgctatttttcgacttggcagcattggacggatgtacaatatatggtgtcttatgaaaatattgtgcactatattttgtgattttaaataaacttccttcttgactttaaccttaaaatcttgtatcctagattggtaacaaaattgggattttttattaatccctcatggacaaaggagaaattgaatggtaacgatctattcaaaaaatgattgtgtacagtgtaaaatgaccaagaaattcttggaccaacatagtgtagattataaagaaatcaatctagatgaacagcctgaatttatcgatcacgtacaaggtctcggtttctcagctgcacctgttatcgaaactgaaaatgatgttttctcaggttttcaaccaggaaaactaaaagccttggtttaactccctactgtttatagaaagagattgcgactatgagtttaaaagagctaggcgatgtgtcctacttccgtttaaataacgaaatcaaccgtcctgtcaatggacaaattcctctccacaaggaccaagaagcggttaaggccttctttacagaaaacgtcctcccaaataccaagcaatttgatagtattttagacaagattgcttatctattagaagaaaattacctcgaaaaagagtttttggaccaatacagtccagaatttatcatcaaaatcgatcaattcttgaaagaccaaaatttccgcttcaagtctttcatggctgcttacaagttctacaaccagtatgcccttaaaaccaacgacggggcttactacttggaaagtatggaagatcgcgttctcttcaacgccttgtattttgctgagggcgacgaagaattagcactaaacctggccaacgaaatgattcatcttcgttaccagccagcaacaccgtctttcctcaacgcaggccgtgcccgtcgtggtgagttggtatcgtgtttcctcattcaagtcactgacgatatgaactcgatcggacgttctatcaactctgctctgcaattgtcccgtatcggtggtggtgttggtatttcccttagcaacttgcgtgaggcaggtgctccaatcaagggctatgagggggcagcttctggggttgttcctgttatgaaactcttcgaagacagcttctcctattctaaccagcttgggcaacgccaaggggctggtgtcgtttatcttgatgttttccacccagatattatttccttcctttcgactaagaaagaaaatgccgatgagaaagttcgcgtgaagaccttatcactcggtattactgttcctgataaattctacgaattggcacgtaaaaacgaagatatgtacctcttcagcccatactcagttgagttggaatacggtgtcccttatagctaccttgacatcacagaaaaatacgacgagttggtagcaaacccacgtatccgtaagacaaaaatcaaggcacgtgacttggaaacagaaatttccaaactccaacaagagtctggctatccatacgttatcaacatcgatacagctaaccgtagcaaccctgttgacggcaagattatcatgtcaaacctctgttcggaaatccttcaagttcaaacaccaagcattcttaatgattcgcaagaatacttgagcatgggtactgatgtttcatgtaacctcggttcaaccaatatcgttaacttgatgaagtcgcctgattttggacgttctgtccgtaccatgactcgtgctttgacttatgtcacagatcattcacacatttcagctgtaccatctattgaagcaggaaacagtcaagcgcattcaatcggtcttggagctatgggacttcattcttacttggctcagaacttgattgattacggttcaaaaactgctgtagaatttaccaacatctacttcatgctcctcaactactggactttggtagaatcaaataacattgcccgtgaacgcaaggcaaccttccataattttgacaaatcaaaatacgcagacggcacttatttcgataaatacgtgaccggagactaccaaccacaatctgaccgtgtcaaagaactatttgaaggaattttcattccaagtggacaagattgggcggagcttcgtgaaaaggtaatggcagatggtctctatcatcaaaaccgtctagctgttgcacctaacggttctatctcttatatcaacgacgtttctgcttcaattcacccaatcacacaacggattgaagaacgccaagagaagaaaatcggtaaaatctactatccagcagctggcttgacaacagaaaccattccattctataaatctgcctacgatatggatatgcgcaaggtcattgatgtctatgctgccgcaacagaacacgttgaccaaggtttgtccctcaccctcttcctccgcagcgagctcccaaaagaactctatgaatggaaaaaagagaacaaacaaactacacgtgacctctctatccttcgtaactacgccttcaacaaaggtatcaagtctatctactacatccgtacctttaccgatgacggcgaagaagtcggcgcaaaccaatgtgaaagttgtgtaatctgatttacagactaaaataaagctattcaatatttctggaggttttttatgtttggatttggtaaaacaaaacaagaaaataaaaaattaaaaagagaaaataacgtactaaaaaaagcttattcacaaactaaaaaagaaaataataagctcaaaaaaacgagcgaccgactagctgcggatggattacgccacggtagtcctgaagcaggaaaatacttagtcggaaaacgcaaaaaataattattgataaaacgaaagaaagtaatatggaaacctactacaaagccataaactggaacgccattgaggatgttattgacaagtcaacttgggaaaagttgactgagcaattctggctcgatacacgtattcctttatcaaacgacttggatgactggcgtaaacttactgctgaagaaaaagacctggttggtaaggtctttggcggattgaccctcttggatacccttcaatctgaaacaggtgtccaagccctccgcaatgacattcgcacaccccatgaagaagctgtttacaacaatattcaattcatggagtctgttcacgccaaatcttactcttctatcttctcaaccttgaataccaagtctgagattgaagacatctttgaatggaccaacagcaacgaatatttgcaacgcaaggcaaagattatcaatgaaatctacgaaacaggtacaccacttgaaaagaaagtagccagcgtattccttgaaaccttcctcttctactctggtttcttcacgccactctactaccttgggaataacaaactggccaacgttgcagaaatcatcaaactgattatccgtgacgaatctgtgcacggtacctacattggctacaagttccagcttggtttcaatgaattatcagaggaagaacaggacaaacttcgcgactggatgtacgacctgctctaccaactttacgaaaatgaagagggctatacacgctccctctatgatgcagttggctggactgaggaagtcttgactttccttcgttacaacgccaacaaagccctcatgaacttgggacaagatccactcttcccagattcagcagatgatgtcaacccaatcatcatgaacggtatctcaaccggtacatctaaccacgacttcttctcccaagtcggtaacggctatcttcttggtgaagtggaagctatgacagatgatgattatttatatgggttgtagatcttaggaaaaatatcatttctatttttccgttttatagtcattttgtttatctttgacgtgaggctgggcaaaaagcccagcgccacttcttagagttcgtgtcaacatctcagcgcagtggttgattggcggatttgttcgtgttttacactctaaatccaacctaatcaactgtgcggcactccagtactgtctgcagctcattgcctagtactaaaagactatagaaatctgttgagtttaaaatcgtatataatgttaatatatcatctcgatgagattggcataaaaataggaattctcccaccagttaagggaaaattcctattttttgtatatattaggcgattcaaggagggtttcagtgagctctcaatcagaatattctacttcgttctgctcctcttcctaagaagtaaaatttgacttaacttagaatgtagaatctttccaatgaactgtgcaatctaaaacctgttgtcgtcccacttggtttccgccctcaatctgattgatcagcatccttgttgcctgacacccttcttcaaaggcgggttgaacaatggtagagatagtaggggatgaaaaatttgtccattcagtattgtcaaaccccaaaagaccaacctgaggaaagtcatatttaagttctttcatagcattaaaaactaaaggtaacgcccagcaattcggaacgaatactagggtcttttcctgaggatttaccaccccttgaagaaaacatttaatttcctctatgtccgtattttcatctgcaattgttaaatcttgataactttgtttacaatctaacagagcatccataaaccctgtagctcgttcaatccgtgtacttaagcgactaatgtcagctgtaataagaataaatttttgataaccattttctacacatagttgagttgcatcatagacagcatcataattatttgtcttaatccaactggtacggtgttcgtaaagctgactatcaaagaaaaccatatgctttttcttatcctcaataatgcgcgaatattttctaaaatgcgatgtcggctgaataataaaaccatctacacccaacatcagcatactctcaatatacttatcttcgctttcttgattgtaattgctgtttccgatgataacttgatagccactcttatgcgcttcttcttctatacctttgacaatttgattggaaaatgtatttgtaatatcaccaatcaatactccaatcaacttagtattttttgaatttaggctccgcgcaacaacgctgggtttatagtctgtttcgcgaatgactctctcaattctttcgcgtgtctctttggacatcttttcatatttaccatttaagtaaaaggaaactgttgtttttgaagtctgagccagttctgcaatatctttgatggtaaacttctctgacaccttaccgatacctcctttagttactttattctatcatactatccgtactttatcagttattttgcacagaaatgactgtatttttttctgtcccttctaatttttgagtcggacaacttgtctcttatccctatccactactaagcacttacctctcaacttataaccagccacttgaagcaatttctctcccttacatatatcattatcagaaaccactaacagaatattcagtccctttccttgacagctaaaagccaaaccgctttctatcaaatgatagtctgtttggtaaactggcaattgcttgacacgaattgcttcatctgctaatagagtaaatgtaactaatctatcttgaaaactctcttttttgaccagtttattggtctctactagttggttgtatcgaggagaacgcacggttttctggatttcaaaatccttttgactatatagccgaagatcatttaaccgctcttctccaatcttgactctttcatctaaaatcaattgactgatcaactcatgctggcctgagcaatcaacgctatccactatcagcaataaatcgcctccaaccataaggagctgtcgtttatgccagtaaggcaagccttggctggtctgagcctgataaatgccctgcatccaatgacagtgttcaaaacccttataactgtgactaataaactgaggatacgtgtcatattcccatgaaccctttatctgccctggagcattgtcatcaaggatacaagtgctgtgagcccaagcgcttttaagcaagtagcgctcctcgcattcacggtagctgaaacgaccgctgtcaattacgattggttgtcctttgtggtaaaagcacaagctattttggtcagagtggctgtgggcacttcccatgggaccggccttgaaacataaatagctgtccacttctttgacaatactgtgaccggattcagaaaaatgctgtccccctgacgagctggattgagcggtcaagtgttcaaatatgcgcaagccattttctccgaccaagaagagaacgcctaaatctagcttggaattatctactaggtaggtgccatcttcaaagaaaatcgcagtcatctgtaagatgtcagaagtacaatgaacatcgctatcgccaagagccacacttttgccatctggccccgtcatctgtaagacatagtctgccatttttttcaaaatagatgtccactgttttcgataatctggcaagctgaaagctagtcctagcaagagtttataaacttccacatggtagagaaaagactgctcaaactgagttccatcttccaatatctgagtttgaatttgctcttcgatttcctgacgagcaaaatggtgaagctctactaaatccacctgatcgccgatataagcatgggccaagagcattgcgccagtctggaaaattccccaattactcaacgtatctttggcacggtaatgactgtgaaggtaagataattgtttttgaatggatactaacagttggctacgctcagcttcacttagtccgccccaatcaattaaaaatgggagaatattgagccagcttagacagcggatagccgtatctaaggtgcgactgctcgttcttttaggataccaatctgtcacttgttctatccaactaaagataaaccgtttaacctgctccatgtagcgcgaatctttttcaaccagataggccaaaactaatttccacaagtattcctgccgattgagcataaaggtccattcctcatccccatggcagtcggctgtccagtcaagaggagcaagatgatacccgactgaacaaggttccatatcccaattgtcttcaaagataaaaatatcatttaataaattttgacaagaaaggagaagctctttataagctgcatcttgttgattgagaatataggttttgaccgactctgctgactgattggctactattttgccgaatattgtttgcataacaagtcctttctctatcgcttctccaaaagaagagaggctgggcaaagcccagatccactcctcaaagttcatatcaatatctcagcgcagtgattgattggctttaacagttcagtggactgctaaaggttggagataggagttccaaaacaaatttcagcaattcgtatttcatactccgaatctgatctaatcaactatgcgggggtgggagtgaaacagtctggggatagactgtttcagctcaacaactagaaataaagacttgttgacgaactcttttttgactagtcgagttctttcccgctcccccttcacccacgaatttcatttaggagtgcgatctgcgacacttgaaatccaccactgcccccaaggttagcaaacctaagaaaccaagacctaaacttgcttcttctcctgtctggggcagacggggcttactcgactttgttttttcggcagcatgatgaaccacttgtttcacctctggacttggttggttttccttgagttgtttttcttctttttctgttttttcgacacttccagtttgtttatcagaaccttctggcatagtaaccttccagacagtggatggataagccgcagttggctccatctcaacagtcagactagaacctgcctttgtcaactcaatgccattctttacggttcgggtagacggattgtaaaaggcgatgcgatagccaccttcgactttctgaatggtatacaaaccggaatctgttaaggtaatatcatctgtcagcttgtaggctgtatccgtgtatttcacaacgccccagacattctgttcttggtcgtataccacttgcaaatccctgtcttgatgaagcaatttcacactagcagccacctgattcactttttccatagattggtttggaacaaggacgtaagcatagttacttgaagtctgtgcatgttcatgccataggctaacaaaggaattgctcacttcttctttcgactggttgtagttgatgtcactccatttgccagttcactggtctaatttggcataggtcggcagttggttcaagaagacgtaaccgatggactggttgtccttgccattggtcatgtaaaaggattgagtcttatctgtcactacttctttggacaaatcaactggctggccatttatgtaatagctatatttttctccggtcaagagtttacgattttcaatcgttgtcacggcgccttgagcagattgatgctgtatatcagtacctaggaaaacaatcttatttcccagaacaatccaagccttacgagcagtcagactattgttccagttgttgaaattcattgcaatcgtcgctaagcggttgcctaactggcttgctccaacaaagtcacttgcaagagttacctcgccactgccatcttctcgtttgtccttggtcgttgtcgttcccggtaagcgatacgggtcaactgttgcccagtagtggttactgtaatgactcaaatcatcattgtagaggtaaaccatgccatctgctgtataccaacccttgcggttttcattgttcatatcttcatagttttgagttttagaagagtacatagacaaggcaaaggtaaagccttcttgagcgcttcgataaacaaacttatccatattgttgaaggctgcaatataatctttatctacttcagcagggatttgattatcagctaaaagcttgttgaccaaatcaatatccttataggatttgaggctgcggtagctgtcatagaaggtatcagaggtcagctgtgccttaacaaaggagagaagtttgttttttttgctcaggctgagccgattctgcaatgcggaccaaagaccttaaaatctccatagcctgaacatgtgattcaccagttgcccgactgatggaacgaccgcgggtcatatccatcagttcaccgcgaaccaatattggcataaaggctttttcaatccattcataaagaatgttggtctgttcttccttgagggcaaactccgttggctgaataaccggtagtaactgtgaaaaaccttcaataaggacatttccatacgcccctgtgtaggcaacattggtgtggtcgataaaggagccatccttgtagaagccctctcccttatctacaaatttcattatcgttgtcaaaccttgtgcaccagccctcacacggtcagcatcttcgcgaagagcaccttccaagatggccaccttgctcaaatccgtctgattaccgccaactgctgggactggattggtcaatgttttacggatatagtggttggatctggtacaaattttgaaatcggtttggtataggttagaatctcctcctgactaaagtagggatgcatgtagatcaaggtgttgacaaccgcacgcggagttccaatttcataatcccaccaattcccatcaattgacttattttcattataaacattggtgtaaagccagttcattccttttctgaccaaatcgataagtgagcggtcgtggtaataggctgagtctggattctcaactacttgagccatctgctccaagcggcgatagaccgttgtcagatggctggatttactaaagtcaatatcgttgaaaatcgttttgccctgatttgttggttcaacccattttttaagagaagaagctacgccggcatctaaacgccctagaaaggctttcatctgagtatcgttagattggtagcgtttattggctaaagaaatatcttcccagttgttccttaaggtatcaaagactgttgcttgatgctccgtaactgtcagctcgaaactagatagtttggtgtctttatcataaacatctacctgagtctttccagccgcaagcggacgaatcatatttttctctactatggccacagccgcatccgcaatccgataggtcaggtctggccgaacaggcaggtagaccttgttgctggcaagacttatttgccctgtttcaggttggacaagttctaggcttggctctggtgtttctggtgtcttttctacgtattcgaccagcgagatgttatccagccaggcttggccgacactattctcaaaaaacagttccaccttcaatttacgagtttccggagataccgtcaagatctgctctatgtgctccgcttgacttccatttttataaggtgtataggcaaattcttgtggactcaagtccttaccttctgcagtcaaactacgcaagcgaacacgaacaccgctccctttcaggtccttggtttctacattatagctaaagagatagcgcttgttaggatctacatccactgtttggtgcactgccactcgatagctagctgttgaagagatatgcagccgtccctcatcaatgcgaacctgtccgttttctttcttcacatttgcaggaatccatgtttcccagtttgtagctgccggatctgcccaatttcctgatgctgctgttgtactggcgaactccccgttggctactaggttcttctcttcttcttttgtcgcctgaacagcttgcggactagcaagagtttctgcagcggtgcttgaaggctgggtttctgttgatgtaacaggactaacctcagagctgacctcgcttgtcattactgcttctgtcgtaagattaactgcttctgtcgtttctggagttgtttccactaactgactgctttgtggactagctgtttctgtacttggcagttgattggctgcaacccttgttcccaagatagacagcgcgataagggcggagcagacacccaccttatatttccggatgccgtaatgctgcttgctttgactgataaaaaatcccattggtgtttcctttcctttttatgcggggcaaaacaatgtcccaggggtataattttaatcctgcaaccgcttccttgcggaggcaagaaagaagaactacttcgtaaaaagtagttctttggcttttcccataatcgactctttttcaacgtaaacaagaacaccttctgcaatctgcaattctaccaagctgtctgttagtttgatgattttcccatgcagcccagagaagaggataacctcatctccagcctgtaaggttgataagtagcgttggcgtttttccagttgctcctcaagtgctttttgttgtcgcttacgattgacataagaagtgagtacaggaagtatggtcgatagagctactaaaataattagtacatagtagagagtttgttgttccataggcgcttatgcaaggatgcccagccagctacccaaaataccgatgataactgtcaggataactagtttgtaggttgtccatttcttgttcttgatgagatagtaaaccaaaatcgtaaacaaggctggaagcaatgcaggggcaatcttatcgagcattccctggatggtcacaattttctgatctgctccttctgtcaattcacccgccgcaaaggtaattggcaccgaaatttttacaaaggttactgctaaaccagagataactgtcacaccgatgatattggctaccttagaaattgttgccatttggtcactcaacttatcaatcacgctggtaccaaatttatagccatacaaaccagtcaacaacttgatagaggtcaagataatgttcattccaaggaagaaaagaatcggtcccataaccagtccttgacctgctagagaggcagcaatcgtagataaaagtggggctaatacaaattgtgaaagtgagtcaccaattcctgccaacggccccatcagagccatcttaatcccacgagtctcttcttctgggagatcattttctaacatgaccaaatgaagactagtaatgaatggaagaaaatgtggattggtattgtaaaactcacagttttcttctaaagctttagttaatccttctttgtcgtcaccaaaatgcttcttaaaagctggatacatgacatttgcatagccaatcccttgataattactgtaattgaaaccattctgcaagaagaaggcccgtaaagaagtgttgagataatcttttttagttagtttagatccagtcatcgtgtgcttcctcctgtttcactgccacttgttctggtttattaaagaattctttaagtgcaaagatactaccgacaattgcgataccaattacaggcagttgtagataagctgcacaaacatagccaagcaatacaaacgggatcaattctttcttagccattacagacaaaatcattgcaaaaccgatagctggaagcatcttacctgctacactcaatccggttaataatactggtggaatcatttcaaccaatttcaaaagagtatccattgaataggcacccaagaaaccaagagcaaatcctaaaaaggcgaaagtaatcactgtaccatttgcaacacgtttaaatttagaaaggtttcctgcacgaagatgtttgatagctgattctggagcacccgcatgtaaagtatatgctgaagtttgtaagaattgaatacctaccgcaataggtgttgaaagtgctaaagctgcttctggtgttacttttccagcacttgtaatagccatcaaagtaccaaaaataccaggtccgattggatttggaggaacggtccccccagcaccaacaccaaatcccatgtatgccagctcactgatagcacccatagctaaagccgttggtagatctcctaaaatgattccgaccccaaaagaaagcacgatacatcggtttgtgtaaagccccaataatagaccgctaaaacagaaagctgtccacagaccaataagagctgcttgaattagactgatcgtcatgataattctccttattttttaaatataatccaatatattaacttcaactgccccatcattaccagaaggcgttgtctttgtgttgaagcgaatcttataaacatcgttcaactctctcactatagccttatcttctgaaccaaaaaagatagaccgtgttacttgcatttttccaggcgcattatgaatatttccaatatttaattctgtgattggtactccccctttaaccaaagctagtgcatcttgcaaatctttaataactaagaaaatagtttgagcaggattagccttatgaatcacatcaatcactttctgcaaagagaagaaacgcatagctactgaatctggaataaccgttttcattaatgtctgctgaatcttatcttcactaaccttatcatttgccacgatgacagtattacaacctaaggatttaacccatagttgtccctgtccatgaattagtcgctcatcaatacgagccattacaatatttggtgttgccattttaacctcctaccaatataattcccaatctttataaaaacgaagcaaagcttctaagtaataataatcgccccaagtatttccttcattgacaccttttcctgaatgccaagagtagaccccatgtaaaagcaatggacgacctggagctaactcacgattagcatagttatcaatcaaggaccgtagcatcgtgtgcatagcatatttataagtttccttgtcctcatcaacttctggcaaatatttaagcatctcgtgaataccacaaaccgctattgctgtcgcagaagaatcacgagcgtgcccactaccatcattaaaaattaaatcccaataggaaacgttatcctctggcaaacgattaagaaagtagttggttactcctttaaacaaatttaaacatgcgggatctttaattttacggtaagctaacggaataccgtaaataccccaagattgaccacgcgcccaggaagagtcatcactaaatccttgtcgggtaacccctttgagcggttttcctgtttcagggtcaaagtaataggtatgaaatgttgaagcatcatctcgaataactgtattaacagaagcgtagaaatgactaagagctacatcataatatttctgctcacctgtctcctcataagcaaagaaaagtaattgtaaattcagcaaacaatcaataatcaaccgataatcttctgctttaccaagttgcccccaggcctgaataaaacctcccttttcttgatagcgctccattaatttatcagcagccaagagcgaagcctctaaagcctctttactacctgtcaatttataatcagctaccgttgatggtgaatacagaaatcccaaatcatgatgatctaattcaattctttgtttgacacgttccaagaaagatgtcgtattcttttttgctaacgctttcatttcattgttcaaagaatactcatgtcctaaccaaagcgcgcccgtccaaaaaccatttgtccactctgtattatccatctttggataatggttatcaaatgtggccggagtcgggaacgattcaccaaaatattcacaattgataacaagttgttgaatcgccaattctattgcagccacaacttctttcttactcaatagagtggaatttctaaactctctttttttagcaattgactcaatcaaaacatccttaatcatgcatttctccctcatataccatcttcaaataactcttcatcatggttatcctctgctaacagactgaccgaatcaacgattccatctttagaggtggtaatcaatttaccaaccaattgttctaaatcatctgttaaccgtgaaaaattcgcttccaaaatcatcgcaagatttaaacctgaaagaacgacaacattctgctctttctgttctgttgctaattctacactaactttaaaaggcgtacctcctagtaaatcagttaaaatcaaaacttctctttcgcctaatatagctgatttgatgcgtgcttttagttcttgcgccgacattccttcactaaaatcaattgcctcaatattctccacctctcctgcaattaactttagtgaagtaagaatcccactagcaaactgtccatgagcaacgacaatcactttaatcataattctctccttttaactttaccggtttacctacactttgtattgtagactattgacaaccacttgtcaatagattttataaaaaaatgtaagcgttttatatttcgttggacttttatttaaaaaatattctccagctccctcttttcataaacaggagtaccaaatatctccatgtttccgttcaaaatttcccctgtaacatctcactttctcccacattcaaccccgttggaggcaggagaaagtgaaaacgttaaaaatacagtccttattttgaaataaactacttcatcttatctctaacacttgtataagaggacgctaattcttgaattgtaccgaactctcctttagtagctaattgattaaattccccaccgataccaagaacagttgcaccagcgttaaaccattctgaaacattattaagctttactccaccggttaccatgattgaaacatgcggtaatggtcctttgattgcagtaatgtagtttgcccccaaaacactaccaggaaacagtttaaccatttcacagcctgcttccaaagcatttgtaatctccgttaaagtcatacagcccggaagatatggcactgcataaagatgacagatttttgcaacttctatattaaaagatggtgaaacaatataacttgctcctgccataatggcttgccgtgccgttactgaatctagaaccgttccagccccaattaaaacagaaacatcatctttatggcatcgactaagttctgtaataatcatattcgcgtcaggatttgtataagcaacctctatagctgtaattcctcctgcaatacaggcctgtgccgtcttaaatccgacttctttgtcatctcctctaacgactacaacaagcccttgctccttcaattttgaaataatttgtgatggactcattttttctcctttatcgtataatgtcatttttcccctctaataaagactcaacttttctaagagattgccgcatgtgatccccttctatgctacatttataagttccactagcaactgcaaaatctaaaatagcctttaacgacgtcccctctaacaatttatataatgccccagcaacaaacgcatcaccactgccaacacgttgtaacacctgagttttcaattcttgagagcaacaaaattcatcagccaatccgtaagccttatacaaatttctgcctagttcatctgtctgcctaatcgtatggaaaattgcttggaacttataggcttcctttaaagtttgcatccgttctcttattgtatggacagtagccgtatctctttcaaataattcccaatctttttcattagccataataggttccagaccaaaacaatagtctgcataggtcgcaaattgcgagaacactttttttgcatctcttaatccaatcatcttagaacgccaattaagatccatcgaaatcggaattttacgacgctttgcttcttttaatacttgaacaagccatgccctaacagctgaaccaatagccacggtgataccactaaagtgaaccaacccaacctctaaaaataattgttccatatcaaaatgatcgacttgaatagcttccaaactagactggccacgatcatagtagacttgactagaacggcaaccaaatcctgcttccatgtagtatacccccacacgttcccccttacgttgaacactggaagtatcaatccctttcccatctaagaaatctaaaaatctattacctagagagccttgtggtagtgcggtcaaaagcttggtttcacatccaaatccttgaagattacaagcgacattgatttctgaacctccaaaaaacacacgactttctacaccatctgtcaattcttgataatttgttggtgtaatgcgaattaaaggttcaccaatcagtaataccttcttcataaccgccccccactctttaactttctaatactgtttttaaatatgttgcaattgactcgtcctgacagttggcaaagaaatattcttggaaatgttcacctgaaatagtttctttcaaaaaatcttgatcaatttcctgaagtactgtcagtaagtctttataggtgactgctttcatttcattcaaaatacgagcatttcgttgttctggaataacgcgttcacggggatatccgccccccatttcctctgcaaacagtcgctcaaaaagtaatttgagatttaattcagctccccaaccgaatccctttgcaaatggcagagacaaagcatttcctccatttatctgtgaaaagaggtatgcatccgtcggatctaccgcgaagccacaaactacccctggaaaactattagccgccaacatggcacctacccccgtgccacaacctgtaataacaaaatccgctgccttactaactagaaggattgaagccaacagaccattttgtacataagtcaactgactttctccctctttaccatacattccatagttaaaaacatgataccctttagcatctgttactgacttcaatgtttcaaaaataagactatttttagcagcctgactattttcattaataagtgcaattttcatcgttttttcccttcttatatcaaaatttgttaaatttgttaattcgtttattacgcttccggctgtttaccaatgtaagcgagaattcctccatcaacataaagaatgtgcccattcacaaaattactagcatcacttgctaaaaagactgctggacccatcaaatcctcagcttcaccccaacgagctgcaggggtcttcgcgataataaattgatcaaatggatgacgagaaccatccttctggagttcacgtaacggagctgtttgtggagttgcaatatacccaggaccaatgccgttacattgtatatttgcttcaccgtattccgaagcaatattcttcgtcaacatcttaagcccacccttagccgctgcataagcagacactgtttctcgtcctaactcactcatcatggaacaaatattgataatcttcccatgcccctttttaatcatagatggaataaccgctttagaaacaataaacggagcatttaggtcaatatcaataacttggcgaaattgagccgctgtcatttcaatcattggaaccctacgaataataccagcattattcactagaatatcaataattccaacttctgattcaatttgagcaaccatagcctgtattccatcttcatcagtcacatcgcaaacatagccatgcgcattaataccagctgccttataggctgccattcctctatcaaccaactcttgattaatatcattaaaaacaattgtcgcccctgcttttgcataggccgatgcaatcgcaaagccaatcccatacgacgcccctgttaccaaagcaatttttccctttagagaaaattgatccaatgaaaattgctgattcatattcgtaactcccttgtattttaatttgtaaagcgtttacaaattgtattgtaatatagtaaaccggttttgtcaacggtttttatcatttattttaaatactttcaaaacgaatcttgatataatcttataaaattcgagtatcttcattccccaagcaataaaatatacttaacacaagtatgattttcttcttcgattttatcaatcattagtaaacattttacatatcattattcatatattatccaaaattggctatactacattcacgaaagtaaaccatacaaaatgggagcgggaagtgatacgactgactccctcactaccaatttcccacctcaaacaatctccagaatattcgaaaactcaactactccgccgagatgttaataggaactcaaacattaacatttttaccctgtgtttactactctaaataaaaaataccctattgcaacgtgcaacaaggtaccatctatctcaatcatatattctgtaattcattttatatagtcatatcagtttatctttgattacttcgacgagcgaggaaacgtcgtttccttatttccaacctagaacagcttttaggctgttctagcaacctgtagctattgaggagaacttgcttcgccctatctccagccttcaaaggttccccgaacctttgaagcgagtactaaaagcaaactaaaagactgatatgtaaagccctttgtcaagtaaaaacaatcgaactgataaaaaatgaaaagtatctagaaagagcctagtttttagcttcgggcattggccactctaatattcgtggattggttacccacaggtcaatggttctgccgcgagtcctactctctataagcgtggatcacaattgtgtcacttagttgtttcgtagatgactcaaaccttgaagtcctaaactccttcaagatactctccattcaaacattatttcaatccttatttctgtccaaattcacccagtgatttgggatagaaatagggattcctcatcgctctgcgatgataaaacttaattgtcaaaagtgtacatgaaaacaagtgctaacttcaagctattcttcctgtcatcatcccccaaataaaaccagataattcccgtgcaatagctgttttagcaacattttgtttcttattttttcctagaacaagtgtgcgataacgtcttcttaagcgttcattagccttatccgcataagcaatcacctccactcggtttccactttgtctccttttcaattctttggatttatacccaatcgtccccttagccaatgattgtgcagcttctatcagaagtcgtctcacatggctattcccagttttggtgatagcacctcttctctccctgtcgccgctagaattttcgctaggagttagcccaagataagaagcaaaatcaaaatgttgagctgtcgcaaagcggttaaaaccaccgatttccgtcacaatggaaagagcggttagtgttttaatgccaataaagcaaaaaagctgagagaccttctcttgataactgtcgctttgacccagttgctcaattcgcgcatcataccgttctatttgatctactaatttctcataggtcaatagatattctgtcaaaatctctgcgtaaagtccatcaatatttaggggacagagccagcggacatgtttctgtgtccaattactgcttccctcggtatagcgaaaatcatgtcggagacagaaggcaagaatttgttgtttgattttcttcagagccactttgtggtctgttctcatgcagatatattctttgacttgttcatcctcaacagtagaaatatgaacaggccgatagctatgaaaggccagagcttttgtgagctgagctgcatcttttttatcagtcttaacacgcttagatccttccttcatcaccgttgtaggcgccatcacgatacagggaatcccgtgagcttgtagctggtgatatagggtaaatccaagacatccggcttcgtagccacataacacttctacatcttgaccatataaacgacgaagctcattcacatagttcacaatatagctaacatttggaccaactttagtgctatgtttgaattgattcgccatcatatcataatagcagagtgaaaaactttctttgtgaacatccattccgatgaaaagtgtggtaaaatgaaacatataagacctccaattgagtgtggtaattcctgttagaagttgattgttttttattctagtgtacaggtaaatccacgaattctcaactgggggtctttacatattgtctataccaaaaatagaatcatcaaataggaaattccattatttaacatatgtagcgcaatcggataacgaatatctcgtctaattaaatagagccaaccaagattgagtcccatcgtgaaataaatcaaaaattggggaagagttgctggcatatggaccagactaaataaagcccccgttacaaatagatagattccaacagccttcatatctgccattttagggaagaaataggtcgcaaaaaatccacggaaaatcaattcttctaaaattggagcaaagatcactactgagctaaatgcaatcaagggataagctgatacgaattcgatcacaagcttttgattttcactttctgggactggtactataaattggatgataaaaaatgcaatatagagcaatatcggccattgaatcttatggaaccatgaagctgtcacacgataggcaacagaatgacgtggatagatatacttccataacagaataatgagcgcaatggagagaacaagaccaattatcgcacaaatccaaattgtactgtcaatcaactgggcaggtatgtctggtatgctttgtaaagttggtcctaccatcagaaaacctgaagcaatttgataggcaacaaagtatagaaatagtaatgcgacgtgtttgataaattttaacataatccctccctaaaagctcaagtcaataatattatcgacccgtaccaacttggtttcaatctccccattcgctaattcacgagaaattttaacccattcctcatcaactgccaaaatagtgtattcataagcaatagaaaattcctcatcaaagcggattttggctttacttccgatcaattctttcaataaaacggacatctgattttctccttttgtagttttctgcaacttttttaccctagcttgcaactgcttcacttttttcctatctgatagagaattgaaaaatagaaatcctactagaatccataaaaatagtttcatcgtatcctcctatatcaagcccagactctgcatcagtagcatcaacaaaaatccaagaagattattcagactgtgtagaataagtgcattggtatatttgccagaaatacgataggcgagtcccaggaccaggcccatacctccgtagacaacccaagatccgatattggtcggattgtgaataagtccaaacaaaaaacttgatagcaataatcccacaatcgaatccttaccaaatactctccccataagaatccctctgaaaagcagttcctccaaaactggagcaaagaaaactgcaaagagaaacaaaactaaggttggtaagcctgaattgttgatgatttcctgattggcagtcgtttgaccatatccctcttccaacataatcaattgcccaccaattattttcagaccaaacataacgataaaagcgaggactacaaacccaacattcgcaaccatcccccatttctgctcacctttccatagacctaatttaccagtcaagataagaccaagcaccacggctaacaataaaagaactgcagcaatcagtagattattaccgtcaaaatttggtagggcaaacatggccaactgggtcaatacattcagtgcaacgactgccagtcccactaagagaaacttccaatttttaaccacattccaatctttgacatttccaagtctattcatagcaatctccttcacatacactaaatcaattcttatcactttcttttttgaacaatagcagagctggcaagcccaaaaccatcggcaagaggatattcagattagacaaatcaatctgcccagtagccagccattctccgaaaatatagccaactgcgtacagaccgagaccgattaaccccacgaagtaaacaatttttagaaccgatataaactttttattctctttcataatcactaccaaaacctttccttatttaaaataccgacggatcatgcgaacctgcatcacattgatataaatgtgcaaaaacgccacaactagaaatgccgtaatttgtcgttcctgcaatagcatgctaagtacaaataggaatagatacaaacctggtaacacgatttgattcaaagtgaagacgatttggaaactcatttcgtagtttgcttgtttctcaccttcgtccatcgcctcagcaaaatccttcatttcttttaccgtagcaaaagcggataacttatagtcacgaattttctgagttaatttcatgataaaaatctgagaaatgagaagaatgacatagaaaactacatcaaaaattgacccgtacatgatcgccccgtcttcgaagaaggtaacaccaaatcctagaaccaaatttaacaatgtcaatgatacagcaacattgaatgaaatggtcgcgtactctaggttacgatacattttcttatatagttcatcaacatgttcctcatcctcatctgaaatggaatgataaagtttataattttgattagctttaacaccaaaatatacggttccagcgaaaattaaaaatgtaataatcctcaaacaaattagaaaattatctaaattgagataagaaggtaggctgaatttaaagattaatattccaaagaaaccgataaagccacccaaaattgctgaaatcagcatatacgctgaatatctcatccatctttgtttcgtcgaaatttgtttcccctgtttcattcttctacctccactaattgaaagacattctccacattttcattaaaaatttgtgcaatccgcatagcaatgaccaccgagggtgtgtattctcctcgttcaatcaagctaatagtctgccgtgatacttctgccaactttgctagctctgtctgattgagaccatctctggctcgcaattccttgagccgattttttaagacatattccataaattttcctttctaggcttggtagataatcaagcctgtttctgtgtcttcgacagctatatttcccttggcaaacttgaccaataagagataggtatagtagaaatcacctgcacaagaggcagcgtgcatggttgccagcatgaagtaaagagtaatattcatcatcccaaaacctgctaccatagtcaagaccaaactaatcacaacaaagggtgctagggaaatcaccagcatttgcatccgattgtagagggaacctggactggtagcataggccatgcccgatttccatttaaacccgtatttgacaggattttcaggacaaaaaaccttgaagaagatgccgtggatagcctcatgcacaactattaacagaatatagagtgggataagcaaccatacctccgacacggatagctccgagtattgcgaaccgttagctatcaaccaactgactatcattccaaatacgaaggcaaatggaaagatgagtaccacagcaagaatattcaatccccacacaaatttcttattttccatgatattaacttcatataatttctttttagcttccatttctcttctctttagatttcattttgtaaaatagcagagctgtcaccaatgtcgccagcaatggaggaaatagataacttctctcagtcaaactcatctcaaaacctaacaaagataaaactttaaacaccaaaatatttatcaagaagagtacgaaaaatagtaggactactttcactccgtttttaactgtcttgttcattcttcttttccttttctctgccgagagtggttttcaaaatgaatagggaactcaccatcatcaagagtggcaccatatctataggctgaccaaatccaagaatttgaacgaaagcatatatcaaaaatagagcaattataacttccaaacctcgcacaacacttgttcctgtaatcaaaattccttttttattgctactggttttcataattttccaccacctactactcgactaattttactactttacctttgactcttttctgccacctagtttcttcaagcttccagttgtcactgcgatggcacaaattgcaagagtcacatgagtctgatccaactgctgccacttcataatgtcagctagtaggacaaaaactagatagatgatcgcgataagttgtacaaaacctgccatgtcactattgtttatctttttcatatatagttcctactttctgtttatttaccagatggattcgttttcatctttatctcaatatcattgtaacacttacttttctttttgacaactatcattgtcaaaaaaataataatttttgtcaaaaagtttatgaagttcgtcaaaatgactagaataacatgcaaaaaactcttctacccaatggataaaagagtttattgagcgattatagattatcagctacgctgttcaagagggtttggattgcagaggcatcgctaccacctgccatggccatatctggcttaccaccaccacgacctgctacgattggcgcaaggactttgatgaggttacctgcatgaacatcgcttgacttgcttgccacaaggacattgaccttgtcgccgatggccgcaaccagcaccaagacatctgagtagtctttctgcttccagttgtcagcgaaggtacggagggcacctgcatctgaaacttggacttggctggcaatgtagcgaatgccgttagcatctttgacatttttgaagacatcaccagcagcggctgccgctgctttttctttcagagctgcattttctttttgtaggtcacgaacttgttgtgcaagactttcaaccttgtttggcacttccttgatttgtggtgacttgatggttgccgctacttctttgagggcatcttcttggtcacgataggcaaggaaggcttcacgacctgttaccgcaatgatacggcgagtacctgaaccgataccttcttctttcaaaatcttgaagataccgatttcagcggtgttgccaacgtgggtaccaccacagagttcgacagaatagtcaccaattgtcaccacacggacttctttaccgtatttttcaccgaagagggccatagcacccatttccttagctgtgtcaatatcggtttcaaccgttacaactggaatggcattccaaatttgctcattgacttcttcttcaatacgacgaagttcttccgcagtaactgcctcaaagtgcgtaaagtcaaagcggaggaagtcttgctcgttcaaggaaccagcctgtgttgcatgctcgccgataatattgtgaagagctgcatggagcaagtgagttgctgtgtggttcttctcaacacccttacggcgttttgtttcgatttcaagtgtgtaggtttgaccaactgaaatgcttgcggacagctcaactgtgtgtaatggctgaccatttggtgctttctgcacatcgatgacagtcgcaacaatgtctccagtagcatttttcacaaaaccatggtctgcaacctgaccacccatttctgcatagaatggtgtttggtcaaagacaaggagggcttgaccttctgagactgcttctgtacgcgcattatcagccacaatgacagataagcttgcttcaagagctgtttggccataaacaaaggtcgactcttctgtgatagcagccagggtttcattttgcatccccattgaaccacctttgacaactgaagcacgggcacggtcttgttgctctttcatagccgcttcaaaaccagcaatgtcaagggtcataccacggtgctcagccaattcttctgtcaattctacttggaaaccataggtatcatagagtttgaaaatgtcacgaccatcaatctcagacttaccttctgctgccaatttatccatcaattgctcagcaaattgtgaacctgtatggatagtacgagcaaatgactcttcttcactcttaacaatcttctcaatgaaggcacgtttttcaagtacttctggatagtaactttccatgatattaccaactgtctccaccaatttgtacaagaatggctctgtaatgcccaaacgttgaccatgcatagaagcacgacgaaggagacgacgaaggacataaccacgaccttcatttccaggaagggcaccgtcaccaatagcaaaagaaagggcacggatgtggtctgcaataaccttgaagctcatgttgtcgccatcttggtcataggtcttaccagaaatcttttctacttcacgaatgattggcaagaagagatccgtttcaaagttggtcttagccccttggaaaatagctgctaaacgctccaaacctgcgcccgtatcgatgtttttgtttggcaattccttgtactcagagcgaggaacagctgggtctgcgttgaactgggacaatacgatattccaaatctcaatgtaacggtcattttcaatatcttcttccaagagacggataccaatgttttcagggtcaaagtcagtaccacggtcaaagaaaatctccgtatctggaccagaaggacctgcaccgatttcccagaagttatcttcaagcggaatcaagtggcttggctcaacaccaagggcaatccaacgattgtatgaatccatatcatcaggatagtaagtcatgtagagcttgtcttttggaaaagcaaaccattctgggcttgtcaagagctcaaagccccattcaatcgcttcatcacggaaataatcaccaatagagaagttaccaagcatttcaaacatggtgtggtggcgggctgtcttaccaacgttctcgatgtcgttggtacggattgatttttgggcatttgtaatccgtgggttatctggaatgacagagccatcaaagtatttcttgagggttgccacaccagagttgatccacaaaagagtgggatcgtttacagggacaagatttgctgaaggctcaacagagtgaccctttgatttccagaaatccaaccacatttgacgaatttgagcagaagataaatttttcataaactaagataccaagcccgattagaaggcgactgaaaaataggaaactgacaggaaatcttgatttcctaggcagtttatcttttttccgagccttccgagcgggttcaatttaacgaaacagttaaattaaacatttcctttcatatagtaataattgaggggaaagtccgtagcccgagttcatttcagaataaactcgataccctttcctttcataagtgatagttaggcgggttcaatttaacggaccagttaaactgaatgattatttcacgattaagtcgatgcatcttccatcatttcgatgtagtcaattgcgaccactaaggaaatgaccaaatctgcacaggagtcctccaatacagtaacggagtaatgagaagttaaatgaaagagttctttggagatttcagctacgagcataccatctggccttttcaagcgaaaatccaaatcccagatatttccgtctaggattaaacctagattttccacagtatagcgatccttgaaaaaagtaaattccttttgcaagtagaaagaatgtccctctaccatatcaatggtaaactggggcaggaaggtcaaaaacttcttagtaatctgacaaacttccccacctctggaattggttacgataaatcgttttggaatttcgagaaaagatccctccacttgataagcaagattcccaaaactatcacgaatatcaaatttttcaccaccaaaggtaaagcgctgtttcacttgaaattgcttcatgataacctcccccaaaaaaataacaagaaatcaaacgaagggcgaaaaaccgcggtaccaccttcattcaatgacttgtcattctcatttaagaaactgtatccacaagcaaaaaacttttatatataagccacaaactgtgaatacaggctctactattcaattgtaatattaagtagcaaaatacttggcttagatggctcgcaacaaccgccaattttctgaactaaggtgtcaagtaccaattcttaataagtaaatcgtcaattactgacctgatgaactagaagattctgttgtagaagaagaactttcagtcgacgaagagctgctcttcgttgaggaagaactgctttcttctgttgtcacatactgtgaaagaagattttggaaagcactgtctttaaccttaacgtttgctttttggagtgcttctttcagcacagtagcaacaaatgatgaatctctttgcttttgtgccaaaataatttctttcagcttatctttataatcttcccatttagcagatttttctgatttagcatccaattttacaacgtaataactcgttgtatacgtcttcatatctaccgaagaaatcaccgacgctccgacttgacctgcatccaaggcaaataccgctttctgtacctctgctggaacagttgttgaagttgaatcgaatttaacttcgcctccattgtcttttgtagtagtatccgtggaattgtctttcgccaattgagcaaaatctgcaccttcagcttgtgcagcagctaaaacttcttttgctttagcttcgtctgccaacttgatgacacgtgctgttacttcaggtgtataggcgtcataagctgccttgtagttttcatctgtcaattctttctcagcagcttgttttacagcatactcaaccaatttattggtacgaatttgttccttataggattcttctgtcaatcctgccgaagaaagtgccgcgttaaaagaagcaccaagttgttctgccttcttatcatattccttatttacttcttctgcagagactttgtcaccatactgattttcaaatacattactgataaccattgacagcaaaacttgttgagcttgtgagtttgtttttactttctcataaaactcagacacagtaatcgtgttacctttcatcgtaatgatatctttatcagctgcattggaacaagcagcgagtgttactgcagcaaagagtgttactgcacctgcgagaatttttttagtttgtttcattaaagactctctccttttttcattaacccctttattataacacaaaagcttaaaaacttcttaaatttctatatgttttaagtcaacattctctacatttttcctcaacataaggagaccgtcactcatggaaacaagactagcagtcacatctggattatccaaagtcgcatcgaataaacgttgcaatcccttataaatcgttcgctgccctcttctgatatccttgatgtccttggcaacatctcctccttggaagatgtcatccaaaatgattaaaccacctactttgacctttttcaagacttctggtaaaaatacaatatattttgatttagcagaatccatgaaaataaaatcatatgtgttatctggtaaagtaggaagaatatccatagcttctccttccagcaattcaatctgctggcgataatcatacttggcaaagttttccttagcaaatccaatcatttcttcatttcgatcaatcgtcgtaatcttcgagtgcgggctattgtcagccatcagtaacgcagagaagccaatagcagttccaacttctaaaatacgtttaggttggagtgtctgcatcagcaagcggaaataagctaccgtttcatgagggataactggaatgttttcttgatgagcaaactcttccagttctttcaaaaaccctgtattttgcgcctgacgtgttcgcataaaatccacaatttcttccttgacaaccggacggcgcatattgtgatttgcgtttttactatatgattcaaccatagaatccattatatcataagccgacaagattttcttcctcaatacactaaaaggtaggtttccccaccttttctctacatatttttggcgtaatcaattcgataccctaaatttccagctagttcttgaagtcgaataaaagtcgcctgcttactgaaaaagagatagtaactatccgtgtccatatctactgcccctagacaaaagttttcatcaagatatttgttatcaatgactcttgcccattctgaaatagatgcaattggacttaatccacctgaatccaatttaagagaaattcccgcattgcggacctgctgaaggcaatcaaaaaagtagataaaatcttcaagattgtccttataatcacgcacacaaatatagttcaaatgctctagtaattttatcaagattaaccaaagattttccttttcagactctccaacacgatccaagaaatcatcgaatgactctgaatctaaaatacgttccataaaattgagaatctcgtgtggatcactggcgaagactacttctctaagttggagaaatagttccctatcaccatttgacattaaatctgctaattcaaaaatatcttgtagttgttcttctgttaacatagtcccctctctttattaatttgaaaaatcccatcttatatgcggtgctacttgctctacaaaatggtaaatatcattaaaatctgcaccatcaagcctattcaagctgacgactgcaagtagtccccccttatttcctacaattcgcaaacgtttcgactgatagccacgatagacaggagaaaccatgtatcgaatctctgcaatctcttctaacgaatggcgttgacgttcactccaaaagtgttcttgaaattctaggtactgttttgtcaatataaaaactgccttttgctttctcaatatatataaataaactagcaaagcttgtaaaaatatcaaatagacaacacttcccatagatggctcttgcttggtcaaaccaccaagacccagcaagattaaaacaaggctaatcacactgggaatgacaatcgaacgtttataggaaatcatattagaggtgcacacctttctcaacgagagcttctaattcttccaaacgggcttcaaataccttgaaggcatcattgaggtaatcttccttggtcatgtctacacctgctttggcaatgacattgagggaataatctgagctaccagccttcaagtagttgagatagttttctttgtcttctggactaccattgacaatcttgtttgctagagctgatgctgctgcgaaacctgtcgcatactgatagacatagaaattgtaatagaagtgtggaatacgagcccactcaaactggatttctggattttcttcggcagaaagtccgtaatatttctcgtttgtctgaccgtacaattcattgaggaaatcagccgtcaagacctgaccttcctggtctgccttatagatagcttgttcaaactcggcaaattgggtctggcggaagactgtaccacggaaaccatctaggtaatgatttagaatagcaaagcgttccttgtcatcttctacttctgccaagagtttttcagtcagaaggttttcgttggtagttgaagcaatttcagccaagaaaagtgaataatggccatagacatagggttgagtcttacgagtcaacatggaatgaagagaatgtcctgtttcatggataagggtgtacatgttatccaagttatcctgccagttgagaagcatgaaggcgttggtgtcgtaggcacctcctgagtatgctcctgagcgttttccttcattaacatggacatcaatccagcggttttcgaaggcttccttcacaatagccgaataatcctcgccgaagatttccaaggtttcttgacattttttaagagcatcttcataagaaatcttggtgctgaaatctgacaatggtgtgtacatatcgtacatcttcaagtcatcaatccccaggagcttcttacgcaaattgatgtaacgatgcaagagcggaaggtgcttgttgactgccgccactaatgtatcgtaaacagattctggaatgaaattagctgcaagtgatgcgtgacgggctgaatcgtacttccgcaaacgagctttcaagttattgaccttgacattagactgaagggtcttagcgtatgtatgctggaactgctcataagtaccgtacatagcttcataggcttcttggcggacatcacggtttttagactccataaagtggatgtagtttccgtgtgaaagtggcaccaagtgaccgtcttcatctgtgatttctgggaaacgcaggctggcattgtccaagactgagaaggtttcagctggtgattcgaaaatttcgctggtcgccgccaatacttcttccacctcttgtgacaagacatggtccttagctgctaaaagtttttcaaattgatggctgtactgaacaagagccggctcttctactttaaaggcttccaatttctcttcagtaatgcccataaattcaggctcatagaaggcaaaagcctgtgaaaagacagcatacaagcccatggccttagcttgaaattcctgatattttccttcgcgagtatcttggtcgttcttcatagacgcatagacatagagtttttcaatgcgacgcataagactaagttgcgtttcgctaatttctaagagacttttagctgagtccagtaaatgacctgcaaattcttttgttttttcagtttcagcttgtaaatctgcaagttctgcttcccaggcttcatcggttgggaaaatagtggttaaatcccactggtatttttcttcaatttcgtaacgttgtttagacataattaatcctccgtattctttattctaacataaaaaatcccctctttccaacggaaagtgagggcttataggttacttatttcaactggaaaacagtttttgccattcgctatcgcaagtcgtcactaggctaacaaagtctacaaccttcaccgacagtagtatgactaacataaaatattgagcatattttcaaaagtaatatatacacctccatcagctatctctacttacattggttttctataaattataggtggatatagaacctgtttctgcttgtcttcaatattgccgtaatactggtcaaaatcctgataaactagggttaaatctttttgtatttgggcaaagccaatggcagagcggggcagacggatgtgggggtaccattcttctgccgtctttgtcagcaaattctcccctcggctataagactctgcctgcagggccaaccaattgggggatttgtaataaagctgttgagcaatgtagcgaggcaaatccctatctaacgggcaagtaagatgcgataaagcttgcttggcaaatggcagacgcaagatgtccaataaatttccctcgccaaatggaaaaacctttgtcagacagtggaccttacctcgtaagtcttcgtgaataaggtaacgaagacgcaattccttcttctcatcatccaattcccagaggtgaaaccccatattcatactaaaagagagaaattgcttgtgcaaattggtcagtcgttccttgagccacaaatccttgccaagcaaccaaagaacctgataaccagcctcactataggcttgcgtcctcagctgcaaacgagaaatgggcagaccggaacattgaacttccaaagctagactattattgacaaataaatcagcgacctgtcctatactagtcaagcatttttcaagttcaacttgttcggcattgactaaccacctgtacagacaagacttgagggacaggtgctgagcggactcattctcggaaaaatagtggcagtcccgcagggttacatgggcaaagtgcgaacgcagaacttttcctgatttgtatcggacaagtcctccacaacctggacaggaaaaactgccttgcggcgcaggattttccaagacattaaaaacttgcccatcttcatcaagtgctactaacatattacctcctttctatattagttcgtaaaaaaacacccagtttaactgagtgtttgaaattttttacccaatctgactgccgtttggcacagatggatcgactgttaagagtgttaaattgtcaccatgttcggctgataggatcatgccctgactgagcaagcccatcatcttacgtggcttaaggttggcaacgatttgaactttcttgccaaccaactcttgctcatttggataatacttggcgataccagacaggatttggcggtcttgtccatcaccagcgtccagacggaacttgagcaacttgtcagaaccctttactttggctacttctttaacttcggccacacggatttccaccttgtcaaagtcctcgaacttgatcgcagctttttcgtttttgagttccacgtcagctgggttccactctttttcttcctcttgggaaatagcagagctgccacccatttgggcttggatataggcgatttcctcttccatatccaaacgtgggaagataggcgttccttttgcgaccactgtcaaacctgctggaagacctgcaaagtcaagattttcaaggtcaaatgctgttcccaaaccaagctgttccataatggcatttgaagtggtcatcatgaatggctgaatgaggtgagccaccacacgaagacctgctgttaagtgagccatgactgctgccaacttgtcacggtccgcttcgtccttagccaagacccaaggtgcagtttcatcgatgtacttgttggtacgggagatgatattccaaacagcttccaaggcgcgtgggtagtcaacagcttccatatacttgtggtagcttgccaagttgtcagctacaactgccgccaagtccgcatcgaagtcagtcacattggcaacaaaagtaggtacctgaccaccgaaatacttgttaatcatggcaacggtacggttgagcaggtttccaaggtcgttggctagttcgtagttgatacgaccaacataatcttctggtgtaaaggtgccatcagagccgactggcagactacgcatgaggtaataacggagtggatccaagccgaaacgctcaaccaacatttctggatagaccacattgcccttagacttggacatcttgccatctttcatgacaaaccagccatgagcaaccaagcggtctggcaacttcatatccaacatcatgagcatgattggccagtaaatggagtggaaacgaagaatgtccttgccaaccatgtggtaaactgttccattccagaacttgtcgtaattaactgtttcttcctgaccataacccaaggcagttgcgtagttgagtagggcatcaatccagacatagacaacgtgctttggattggacggtacgggcacgccccatgtaaatgaagtacgtgacactgccaaatcttccaagcctggctcgatgaagtttttcataatttcattgaggcggccgtctggctggataaagtctggatgagcattgaaaaactcgaccaacttatcctgatacttgctgaggcgaaggaagtaggattcttctgaaacccaggctacttcgtggccgctcggagcgataccacctgttactttgccgttttcatctcggaagacctcttctaattggctctcggtgaaaaattcctcgtccgatacggagtaccaaccagaatactctcccaagtaaatgtcgtcctgcgctagcaatttttcaaaaacagccgccaccacttcctcgtggtaatcatcggtcgtgcggataaatttgtcgtaagagatgtccagcaagttccagagctccttgacaccaaccgccataccgtcaacgtaggcttgcggagtcaaaccagcttcttttgccttctcttcaatcttctggccgtgctcatcaagccctgtcagataaaaaacctcgtggcccatcaggcgtttgtaacgagccaatacatcgcaggcaatggtcgtgtaggctgaaccgatgtgaagttttccagacggataataaatcggtgtggtaatgtaaaacggtgtttttgtcatgtttttttcctttcaaattcagagcaaatgaaaccctgttattgacaacatcctattttatcatattttcagctaaatcacaaaatggttctaactacaagtcttcctctatctatgctatactatgatacaactcaaacagaaagaggtcatctatgtttacaaagaaaaatattcttactcatctctttttcctcatcatagcagtcggactaaaacggtacggtgtcacagcacctgacttgacatggaatatgttcttggcattggtagcacttgattttgcaatccttaccaatcatacaaagtcccatatcctcaaagtgatagcaggtctcctctggctctttttctaccccaatactttttacatggtgacagacatcgtccatatgcactttgccaacacagtactatggcaacgagaaagcatgattctatttatgctttatgttccaagtattttctttggggtcatggctggcgttgaaagtgtacgacttattttctctgctttttctatcaaatcctactggctaaaactgtttatgattagtggtctttccctactatccagctttgccattcatatcggacgatatgcaagactgaattcatgggacatctttaccaggccaactgtcgttattgatgaaatgcttgcagttatttcgtgggattctctcccctttatcctcggcttcacctttatccaaattatggttcttgtcttttcaataaatgaataagatttttatctcatagccattatcttcaagcatcttcccacactcaaggactatcgttccttttgggaagatttttcaaggacataaacaaaattttttgataaatttatatcttctccgtttctctccattacatttttatccaaactgtatgaggcaaaaatcgttaacctattgtaagtaaaatttcttaaatttccttatatataaaatattcagaatttactgtaaattctacataaaatcatggatattgattttaaattcttaaaaataatggtataattgaggaacctataaatgaaagagggagatctattgtttacaccaatcagcgaaaaaattgacatcaatcaagtacgagaacattcaaaactttctccagaaacacttgctaaaaaacaagctcgtgaccgtgaacttgaagccatcttaaaaggtgaagataatcgtcttctcctagtaattggaccatgttcttctgacaatgaagaggctgtcttagattatgctcaccgcttggccaaactccaagaagaggtcaaagataaaattttcatggtcatgcgcgtctatactgccaagccacgtaccaatggtgatggttataaaggactcatgcaccaaccagatacagatgctgcaccaagcctcatcaacggaatcaaagcagttcgtaacctccactatcgtgtcattacggaaacaggtttaactactgctgacgagatgctctaccctgaaaacctgcctttggttgatgacttggtttcctacatcgctatcggagctcgttcggttgaaaatcagcagcaccgctttgtagcgtcaggcatcgatgttccaacaggcttgaaaaatccaacgtctggtaacctcaaagtcatgttcaacggtctttttgctgctcagaagaaacaatccttcctcttcaacaatactgaagttgaaacatctggcaatccacttgctcacgttattcttcgtggcgcagtcaatgaaaatggtaaatacctaccaaactattactacgacaatctcttggaaaccattgagctctatgaccaatttggtttgaaaaatccattcatcatcatcgataccaaccatgacaattctgggaaaaattatttggaacaaatccgtatcgtccgtcaaaccttaatcaaccgtgactggaacgaatccattcgtaactacgttcgcggattcatgattgaatcctacattgaagacggtcgccaagacaatccagatgtctatggaaaatccatcacagacccttgcttaggctgggaaaaaacacaagaactcatccgagaaatttacaacagataggaagatactatgggaattcacaaacgtagcaccagtttagacatcgataaagtaaaggaactttccaagttagaaggagaatttctagctgcaaaaaatcagcgcgatgaagaactgaaaagaattatccgaggcgaagatgaccgtctgctcttggttatcggtccttgctcatcagataatgaagaggccgtcctagaatatgcacgtcgtctctctaagcttcaagaggaagtcaaagataaaatcttcatggtcatgcgggtttacacagctaagccacgtaccaatggggaaggctataaaggactggttcatcagccagatacttctaaattaccagacctcattaacggaattgcagccgttcgtaatttgcattaccgtgtcattactgagactggactcacaactgctgatgaaatgctctactctgccaactaccctcttgtggaagacttggtgtcctaccatgctatcggagcacgttcggttgaagaccaagaacatagatttgttgcatcaggtgtcgacatgccaactggtatgaaaaacccaacttccggtaatttgaccgttatgttcaatggtatctacgccgcacaaaacaaacagaactttatttaccgtgatgcagaagttgatacagatggcaaccctctagctcatgctatccttcgtggtgccaatactgaaaagggcggttatgagccaaactactactatgatattctcttgaaaaccatcaaacagtatgaacaatttggtcttaaaaatccatttatcgtaattgataccaaccatgataattctggaaaaaattacctggagcaaatccgtatcgtccgtcaaaccctcatcaaccgtgattggaatgaagctattcgcaagtacgttcgtggtttcatgattgaatcctacttggaagacggccgtcaagatagccctgaggtattcggcaaatccattaccgatccttgcttaggctgggaaaaaacggaagctctgattcgtgaaattcatcaaaccgtctaattctttccttaattttttatacgataaataatttggaggtaagctatgaacattgatggttacactcgtcttgctgccgttgttgcaaagccaatcaaacactccatttcccccttcattcataatctggcttttaaggaaacaggtgtaaatggtgtctatgtcgcttgggaaattcccgaggaagatttggctgtaacgcttgaaaatatcaaacgatatgatatgtttggtatcaacctgtccatgccctataagcaggctgtcatcccttatctcgatagcctgactgactctgctcgcttgattggcgctgtcaataccgtcattcatcaggatggcttactaatcggtcataataccgatggcattggattcttcaaaagtttagaaaaactaagaggattccaagtacgcaacaagcgactaaccatcctaggtggtggtggtgcttctactgctatcatagctcaggctacattggatggtgcaaaggaaattaccattttctgccgtcaacaaagcttggaaagaacacaggcgagtcttacacctattgctcgagcaactggagttcccatgcagatcctagcgcttgatgatagccaattactacaggaacatatcaccaactccgacttactagtcaacggaaccagtgtaggcatggatgggtattctcaacctgttccttctaccattcgctttcccgaaaatcttttggttgcggatgtgatttatcaaccattcgaaacacctttattaaaactagcccaatcacaaggcaatccaactatcaacggtttgggcatgctccttttccaagcagctgaagccttccaatcctggactggacaggaaatgccgactgacttgatttgggaccaattagtccagaaatatgacatcaaatagagaggaaatctgatgaaactgaccgtcaatcttcccaacactccctacgacatccttatccaaagaggaagtttagcacagacaggtgcatgggtcaaagaactttggaaacctcagaaaatcgccattattacagatgaccacgttggctcactctaccgcgaaacagttcagtcaagcttagaacaagctggttttgaaaccattgtttttgaatttccagaaggtgaagcctcaaaaaatcttgatactgtcaaccaggcctacgaatttctcgtaaaaaatggtatgacacgaagtgatggaatcattgctctcggcgggggagtcgttggcgatttggcaggttttgtcgcttctacctatatgcgtggtatccatttcctacaaattccaaccagcctaactgcccaagtcgattcttctatcgggggaaaaactggcgtgaacaccccatttgccaaaaatatggtggggaccttctgccagccagacggcgttctcattgaccctgataccctaaaaacactcggcaaacgagaattgattgaaggaatgggcgaggttgtcaaatatggcttaatagatgatgtggagctctgggaaaccctagaccaattagacggctctgtcgagagcattctggagcatgctgactatattatctaccactcctgtgaagtcaaacgcaaggttgttgtcgaagatgaattagacaacggtgtcagactctatctcaacttcggtcacacgattggacatgctattgaagcgaccgctggctacggccaggtcatgcacggtgaagctgttgccatcggtatggtacaaatctcacgcgcagctgagaaaaaaggactgatgccagctggtatgacagcaaagattatcgccatgtgtgaaaaattcggcttgccgactacacaccagccttggaatgtagatgaattatacgcctccctaactcacgataaaaaaacacgtggcaagaccatcaaacttgtcatcgttcctcaattgggacaggctgccatccatcaaattccaatggaagaaatgctagaatttctacaagtatagtcatttagttgacttttacgtcgaagtaataaaagtcaactaatactcaatgaaaatcaaaaacagactaggcgacgcagatgcagatagaactgaagttcatcaaattaagtcaacaacgtctgattttgattttcgaagagtataaatgacgatataagaaaaaagactactgacttgcatgaaatcagtagtcttatttttttataaaatcatctcatcgtcagttagcttttcaccgctgtttttgtagaaaaggtccatcaagttttgaacagtcaagttcttcttctcttctccttctacatcgacaacaatctgaccacggtgcaacatgaccaaacgattaccatattcaatggcgttttccatattatgcgtaatcatcagagctgtcaactgatgactttccacgattttcttggtcaattccataaccatatcgctggtttttggatcaagggccgcagtgtgttcgtccaggagcagaacttttggtttaaccagcgaagccatcatcaaggtcagagcctgacgttgaccacctgaaagaaattgcgtgtccaccttcatacggttttctagtcccagaccgagctctttcaaggcttccttaaaaatagcacgttcactatctttgaccccccagccaagaccacgtgacaatccacgacgataggcaatagccatattttcttcaatggtcaagcgagaagctgttcccatcttaggatcttggaaaacacggctgatgtccttagagcgtttggcagctgagacatacttaatggatttaccttcaagcaaaatatcgcccgaatcaaccgtcaaggcacctgcaagtgagttcatgaaagttgatttaccagcaccattaccaccgatgatagagataaaatcaccttcttttacatctaagttcaacccacgaaggacatggttctcattaactgttccagcttcgaaggttttatgaatattttggattgataaaattgtagacatgacttcctcctaagcatttccattcaattttggacgacgaatattcaatttcttctgcaattctggcacatagagaacggttgccagaaggatagctgagaagagtttaacaaggtctgcatccatacctggaatttccaaaatcgctaagataatcaaacggtaaacaactgcaccgagaacaaccgataggagtctccaacccaagcgtaagttacgcaagataacttctgcaataatgacagatgctagaccgataacaatggtacctgtaccagagttcaaatccgcatagccattattctgagtaagaagagcaccacaaagggcaattagaccattcgacaacatataaccgtagattttcatattatctacattgataccattggcctcactcattggaatattatcccctgttgaacgaatagctagaccaatttgtgtattgagcaagagcgtcaataagcctacaactgctagtacaaagaccagaccaatcaccaaaacagcatttgtttttgtcaaaccaaaatcctgcaattgggtcactagagtttcttgcttaagcagagccacattggctttgcctaagattttcaagttgatggagtagagtcctgtcaaggtaacaataccggtcaaaagggctggaatttttagttttgtatgaagtaaaccagaaatcaagcctgcacccataccagctaccatagccataaaggttgccagcaagggattcactccgttcacaatccctgtcgcacaaacagcagctccaagcggataagatccctcagctgtcatatcagcaatatctaaaatacgaaacgtcaagtaaacaccaatcgccataactgaccaaagcaagccttgcgagatacttgataaaataatatccacgattttctcctttttctaaattcgtagtcaatactaggttctatcttaccgatcttattcagatacagcaagcttagaagtatcgatacctaatttctgagccatttcttcattaacgtgaagactgacggtctctgggtattctactgccgtttctgacacattggctccttcgataatcttaatagccatttttgcagtttgacgacctaaagcttcatagttggtaccgtaagtcaaaagacctccttcatccaccatgtccgttgaaccaccgattactggaaccttatgctccacagataattcaccaatcatggtcatggttgaagcgacagtattgtctgttggaataaagagagcatctacatccttcatcaagctagttgtcgcatcttggacttcatttgaagatgtgattccttttactactaccttataacctgctttttctagcaattccttagcttgctctacctggacttctgaattccgttcgctagtagtgtacaaaataccaacggtcttagcatcaggaacagcttgtcctagcaattcaacctgtttgtcaattggagcttgatcagatgtacctgtcaaaagtccacctggtttttcaatggattctaccaagtcagctgacaagggatctgtaaccgcagtaaagacaatcggcgtttcagtagacacagtcgctaaactctgggcagacggcgtagcgattgccaagacaatatcatttccatcgattaattgttctgaaatggtttgaaggttagcttgatcgccttgggcattttgataatccaaaaccaatttttcaccctctttataaccatttgcttctaattccgccacaaaaccctcacgggcagctgtcaatgattcatgctccatatattggagaactccaacttttaccacatctgaggaagcttgttctgatgatgaggaacaagctgcaagtgttagcaaacccatacttgctactgaaatagttgccaatttttttactagcttataatacataaacgtttcttctcctaaatattttactcttctaatgcttttatagtcgctgcatcaataccaacagctttagccatttcttcattgacggtaatagccgctgtatttggtttttcaactgctaagtcagcaggcttttcacccttcaaaatcttcacagccaattcaccagcttgaacaccgatagcatggtagtcgacaccgtaggtaaatagagctgcgtcaataactgccgcgtcacttcccatagctggaacttttgcttcttttaaaatatcaccgattgttgaagctgtagaggcaactgtattatcagttggaagatagatagcatcgacttttcctgcaagtgaagtaatagcttgctgaacatcgtttgtcgtcgtaactgttgtcacttctacttttacaccttttgcttcgagtgcttttttagcctgctcagcttgaacttctgagtttacctcgctagaattgtagaaaataccgacagtcttcgcagttggtacaactttgagcaacatctcgatttgaccttccacatcagttgcatcaatcgatcccgtcatggtcccacctggtttttccaatgattcaaccaaacctgcttcaactggatctgtgacagctgtgaatacacttgatgtttcactatctgcattaagcatggtttgggctgccggtgttgcgatggcaaagttaagatcattttttcctgccaatttctcaaccattgtctgtaagtttgcttgatcaccttgagcattttgcaaatcaatcgtcagattttcaccttccttgtagcctgcttcttcgagcgcctctacaaagccttcacgagctgagctcaacgcttcatgttcagcatattgaataataccaacattgactgaacttgaatctgacgaattggaactacatgcagcaagcgttactgctgacaaaagtgctactgaactaagtataatttttttaaatcccatgattattctccttttataaatataatagcaaacaagaaaggaccgcttagactacactctaaacggtccttatatttcatctgtataggaaaacagaatgaattatccgtgccatttagatgtatcatctatgaggcacatgtcaaaatagctacagccacatagatacaaactttacgttcccgtgtttgcatccatgtttaccatgtctacaaacactatctaaaatagccgtagaaataagtatgattagctgaatgattttgacacatttgtaacatctctgtttccctttctcatttatttgtaactatcataactgttttcaaattatttgtcaatagggaattgcgtaaattttcagatttttcaagttttttcgaatttttctaaaaatagacccctatattattagctataaaacgacctgtcatcttgtttatatagccttttagtttacttttagtacttgctccaactatttcacaaatagtcagaggttggaaataaggggaacaaggtttgcgtcaacaaccgcagctataactgtttctgggattgcttgcacagtaaatggactgttcaaggtgagagatataagagcggattgcaaaaccaggtcaacatcgactgattttgattttcgaagagtataaatgactatatttgatgttacaaaaagtctgaacctaagcccagaccctactaaaacaattattttacttcaactttttcagtccaaggacgcgctgtaattgctagaacctcgtttagttcttctacgttgcggcggccttgatccgccaaccaagctttggctgcttcttcaccctcgcttgcaaagatggctactgcatccttccaagtcgcccgaccacaaagaacaccattaaagcttgaaccagcttctttggcaaagacaagggtttcttggaaaagtttagcagatacgccagcgctcaaataaatgaatggcaagtgagtgctatctgtttgttccttgaagaaggccttagcttcctcaactgtatagactggctcttcatctgtgtaaccttctacaaagttcatattgacaggtacttcaaccttgagcacgtcggcattataacgtgacttactaaattcacgcatggcaccattgaccttgtgtggtttgagggctgcgtattcacgagaagtcacatccatatcgctggcatcgtaagtcaagatttcgacgaagtaaggaatatcttctgcgatacactcactaccaatgcgttctacccaagcatgcttaatgtcgttgatttctggcttgtcatctacatcatagtaaagcaagatttttacggcatctgcacccaattctttgatacgtttggctgaccaatttggcaaaaggtctggcaaacgacctggtgtagacgcatcgtaacctgttttttcataagctgcaatgaaaccgcaatctgcatggcgcaattctgaagccggaacgccgtattccgcatccaagagaatggagcttgcataaggagtcaaatcgcttgagatgactttcttgaagtcaatcaaaatgtcatctccaaattcgccaccacctgctgcagcagcaagcaagcgtttcaaagccccccgttggtcaatcgccaaagccgcaatcacctgatcgctgtttgacaagcgagtcatgtgattgaatttagcctgagaaagttgtaattttgtcattagtttcctcctaaggattttattaaccaaatcgtttcacgccatctagataggtcgcttgtaagcgtcctgcatcatctacgacgataaagtctgcagctcggccttctgcaatccgaccacaaatatggtcaatattgacagagcgagctggtgccagagaagccatacgaagggcatcaggtagggataccaagccccatttcacaacattctgcactgcttcaatcaattctaagatagaacctgccaaactaccactttcttttaaacgagcagttccatcttttacaacaacttcaaattcaccgaggcgggactccccttcacccataccgccagctcgcatacagtccgtaatcaaaacagtttcctcagctccacgtgctttgaccacgatttctgccgcagctggatgaacatggtgtccatcacaaatcatttccgcatagacattttttaaattcaaagcagcaccgaccatacctggttcacggtgatgaagcccactcatcccattgtaaacatggacgaagatattggcaccagcttctactgccgcttccgcttgcgcataggtcgcatcgctgtgagccaaggcagtatgaattgccttgctgttagcaaactcgatgaattctttgacgccttcacgttctggagcaatagcaattttattgactaaacctttagataagctgtgccaattgtctaacttttcaatggatggatcgctcatgtacttaggattttgtgctcccttgtatttttctgtaaagaaaggaccttctaagaaaataccttgaatcttggcgcctgtttcctgccctgcataagtcccaatcgtttcacaaactgcatctaaattttcagtcgtatctgttaatgtcgttggaagccaagaggtcaccccacaagacaagagaccttctgaaattaccttgatcccttcaaaatcattgtccataacatcgtgagaagcgtagccgtggatatgtgtatcaactagccctggtgctaaatgaaagtcagaataatcaacaatctccccttcaggcttttcaatcacaatccgtccaaactgacccttgtcagtaatttccaaataggctgattcgacctcactctctggtaaaataatagattttgcttttataaatactgtcatattatctcctttattgatatatatacttatcaaactggttataaccatataccaaatatattgtagaacttctattagaaaatgtcaagtaattaccataactttataagaaatggatgctgtgagaaggtagaaaaaagagttcttactgccctaagtaccgtttctgaatctgtacttggagataagaactctacgtaagcagtgtatactaggcgtcaatccatgacctaacaccctgctcctatcaaatataaatatattacaacaattcgttgagaggcttgaagatgatacgttccaaatcagctacataagttcccaactgttgttgcttgctgaaatattccgtcaaaagtggatttccctgaactttcttgttgaaatccaacattttcttttggtcagcttcagtaggaatttcaccagcctgcaatttagattggatctctttttggaaagaaatataactttccaatatttctttggcttctgaattcccctcaactgagaccttaacggcttccaccgccttatattcaggcaggttacggattgcacgttccaattcatttgcgatatcatagatatttgttgacatatttttctcctaatctaaatggattttgtaagtcgtctgctctcttaaacgtttcgcagcgtcttccaaatttcccttgtttttaagcgtgatttgtaaaataccgtgtatatcttcacggttctcttcattgatacgaatattgacaatggaaataccccgtaagacttccaaaaccttcaaaatcgtatcttcctcatcaggaacactaaggaataaatcgtagaaagaatcaacacctgcacgcttgtgaatttccatggctttacgagtttgacgtcccttatcaaaaaagtcccaaattgctttttgatcgccagatctgagaacatctgaaatttctgaaagacgtgcttgaaattcctcgattcgatttagaatagaatctgcattggttagcaaaatgctagtccacatgctcggctcactttccgcaatccgtgtcatatctctaaatcctccagctgcaaaattattcgtaaagggatgatcttgagcatactcaccagcttgatgcatcaaactagaagccaatacgtgtggaaaatgtgaaatttgactggtcacacggtcatgttctgctgcatcaatctgaacaaaacgtgcccccgttccagataacaagtctgtcaatcggggaaccgcatcctgcttggtagcctgacacggtgtcataatgtagtaagcattctcaaatagatggagatctgctgcactggcaccagatttatgactacctgccatagggtgtccaccgataaaattaatttgtcttggcgccaaatgttcctcagcagcagccacaattgcagacttcgttgaacctgcatctgtaatcaagaccgtatccttcaattcaagggcactaaattcttcaatcaaacgcaaagaaacttgaattggaacacaaagaagaatcacatcagcctgctttgctacaccctccaattccgttgatacctcatcaaccatccccttgcccaaggcaatttggcatgattgttcgttaggatcaaagccaatgaggtgatagtctggatggtctttgcgaatacagagcgcaagtgaacttccaatcaaccctagacctacaattaaaatcgtttttttcattaattacctagaaatttttgacatagtcgcgatgactggctaccgcagctttcaattcctccatattatcggaagagaacttctctaggatttctgtcgctagagttgtagctacgactgattccatgactacaccagctgctgggagagccgttggatctgaacgttccacagtagctttataaggctcatgagtatcaatgtcaaccgacatcaatggcttatagagggtcggaattggtttcataacaccacgaatgattagggcctcgccattggtcataccaccttcaaaaccacctagattattggttcggcgtgtatatcctttttcttgggaccagagaatttcgtccatgacttggctccctttgagataaccagcttggaagcctactccaaattctactcccttaaaagcattgattgaaacaacagcctgcgctaattttgcatctaactttttatcccattgcacataagaccccaagccagctggaactcctccaacaacagtctcaatcactccgccaatagtatctccatctcgcttgatttgatcaatataggctttgatttcttcttcacgctcttggttgacaatggatacttctgactgggctgcacgctctttgatttctgctacgcttaaaccatctgggacatcaatttccttccctccgaaaacgactacatggttagcaatttcaatatccaactcagccaaaatccgtttggcaaccgcaccaacagccacacgcatagttgtctcacgcgcactagaacgctccaaggaattacgcaaatcatcaaagcgatatttcataccaccaactaggtcagcatgtcctggtcgtggatgtttgatacgacgcttacttttgagtttctcttcgatgtcctcaactgccataatatccaaccatttttgatggtctttgttggtcacattcaatgtaatcggggcaccggttgtcttaccgtgacgaacaccagctgtaatctctacgcgatctgtttcaatctgcatacgactaccacgaccgtatccaccttggcgccgttttaactcttcattaatatcctcggcagttaaaggaagacccgctggaactccctcaataatggctgttagacgtggtccatgagactcaccagctgttaaataacgcataacttaattctccaaaatttccagaaacttacgagtattgcttaaagacatttgtcctggtgcagatgtttcatctaagctggcaaaagtccagcaggagcctgtaatcacacctgcaatacgtgttaacttccctagttcacccatggcgattgtcgcaaatatctgctcagtgttcagtgatttaaaaccacgagtataattcataacatctaggacatcctgctctgtcttagccattacagccattttaacaacagctggtgataggctagtcagttcagacatgatttccatataattagacggtgtttcttcaaaattatgataactcaacacaagattaggaaactccaacatctgctcaaaaaccgacttataagagtagtattcaaaatcaatataatctggctgataaagcgttgctacttctttgattacattgacatattcttgatcgtccaaatccaagtgaccgccttcacgtgttgtccgaatggtgaaaactacttccttaccactacatttttcaaatatagcaggtgctactcttaaaatatcatctttcagaagatagtctgctcgccattcaacaatatctgcctctgctaaacgttctacatcaatggcctctacctcttccagatttctaggcataataggaactactattttcatttatctacctgtatcgtaaagacctttaggtaattactactttcatcatttttattgattacaaaatcggctggcaagcgataagttgcctcatagcgatgttttctaacatcaaaccctttttcaatctgccgcttaaatttttcaacagaaacatttgcggcgttggtcgaagcgataatagttccacctgtatttagtatttccaaagattgagaaatcaacttgtgataatctttggctactgaaaaggtttgtttcttatttcgtgcaaagcttggcggatccaagacaatcacatcataagttaagcctttacgtttggcatatttgaaatattcaaatacatccattactacaaagtggtgattatctaagtctaaactattaaccttaaagtgagctttagaaagttctcgcgagcgtttggctaagtcaacagaagtcgtttcctctgctccgcccatggcagcagcaatagaaaatgctgccgtatacgagaacatgttcaaaagtgacttgcctgccgccaggccatccaccaaggaaccacgtacctcatgctgatccaaaaagattcccgtcatcagtccatcattcataaagacctgatagtgaactccattttccaacacagtgaaatactcaggggcttcttctccataaagatgagcagactcaaaggccaaacctttaaaacgaatcttctcataagctcctcttacttctggaaatacctgttgaaatgcagcaacaatcatctctttgacagaataaataaaggtattataccatgaaaaaactgcgtattcatcatacaagtcaaccgtcattccaccaaaactatctccatcttgattaaataaacgaaaagcgttcgtcatctcagattgataaaaatgttgacgtttctgtttagcatccacgaataatttaacaaaaaaatccatggtcaagtcttgattgcttctactaaacagccagcctatccccttattctgtttggacaaataagcctgacccaaatagcttccagactctgaatacaaaacagccagcctgtcttcatcaaatgaaacacctgaaaaatcagcgctatccaagagttgaatccctctgtttattttctgttctgcaatacggtttacctttattttcatagaattattataacatgtttcttcatatatgccaaaaaaactctaaactttgaggcttattttagaattatggtataatgaactaaacttttagaaaggaccatgaggttttattgtgaaaaaactaattgactatgtcaagaagagcggacagactagacttggtttcgtcttgattttgctaatcatttactggctcaaaacactctgggcctactatgttgatttcaacttagatacacaagggtttttccaaaattttattgctattatgaatcctctaccagtcgggattttattactcggtctctcgctttatataaagaatacaaaagtcttctatagcgtagcgatgatcatttatattattctttccgtctggctcttttcaaatgcagtctattacagagaattttccgattatatttccatctctactataatggctacctctagtgtatctgctggattaggagaagcagctcttaagttatttaggctatgggatattgtctattttcttgattttatcatttttggaatcctagtctatcgtaaactactccggtgggataaaaaaacatttcataaaaaatctagctttgctattacagcactatcagtcatgcttttctccatcaacctctttttagcagaaattgatagaccagagctacttacgagaggattttctaatacttatatcgtcagagcccttggtttacctgctttccttggttacaatgctaatcaaacctacaatgcccacaagaatcgttctggagcatcagctacagatttggagcctgtgaaacaatatattacagaacattatgctcaaccgaatgacaactacttcggtattgccaaagggcgaaatgttatctatctccacctagaaagcttacaacaatttgttattgactataagttgaatgtcaacggtgtcgagcacgaagtcacacctttcctcaattctctgtatcattctagctctactcttgccttttccaatttctttaaccaagttaaggcaggtaagacctctgatgccgaaaccatgattgaaacctctctttttggactcaatcaaggctctttcatggtccaatatggcggaagcaatacccaacaagctgcaccatatattctctctcaaaatggaggatatacatctgctgtattccacggtaatgcagccagtttctggaataggaacaacacctataaacaatggggttacaattacttctttgatcaatcctatttctctaaagccactgctgaaaattcattccaatacggtctgaatgataaaatcatgttcgccgactctatccaatatctggaacatttacagcaacccttctataccaaatttatcacagtttccaaccactacccctatacaaccagcttgattggggatgagattggctttccattagccaatacagatgatgaaaccattaatggctattttgctactgccaactatctcgatgcgtccataaaggcatttttcgattacttaaaagcgactggcttgtacgaaaactccatcatcgtcctctatggtgatcactatggaatttctaattcacgtaatcctgacttggcaccgttgattggaaaagattctcagacttggtcagattttgacaatgccatgatgcaacgtgttccatatatgattgttgtacctggaatgaccaacggtgggatttttgatacctatggtggtgagattgatgcacttcccactctcgaacatcttttaggaatcaaatccgataactatcttcaagttggtcaagacctactttccagccaacacagccaaattgtggctcttcgaactgctggcagttttatcacaccaaaatacactagctacgaaggtaaaatctattatacagaaactggtcttgaaattacaaatccagatgagacaactcagaaagaaattgatgcaattaaagaagctactgcagcacaactggcgactagcgatgccattcaaactggtgatcttatccggttcttcgacaatggattgccagccttggatccaagccaatataactacattgactcattggctgccgagattgcactagagaataaacttggcaaacaatcaacaagtttgtatagcacaaacggcaataaatcaacaattgaactatttaaagcaccaagctacctagaacttcacggtagtacaactgctaccagtacaccaaatactggtacaagcactagctcaacaagtaccagttcaaattcacggtaatacactataaaaggcttagaatcatgtcagttactacattgattctaagcctttttatactcaatgaaaatcaaaaacagactaggcgacgcagatgcagatagaactgaagttcatcaaatcaagtcaacaacgtctgattttgattttcgaagagtattagaccactatttcaaatcactcatatctatttcatcaaggaaatataaaatcctcactaggctcttcctctgttgatgattttttagggatatctatgggagcagcagtactactttcagttgcttttgtatcttctgttgtagtttcagcttctgttacagtttctatatctgtcgcttctggactaggtgtcaacaaatcatctaaccagctatctgcgtcctcttctccattagggacatctggagtattcgccaatggattcccaggcaaccaagtatcacctggctcaactgtcccatctttgctatcactttcaactttatcgaaatgaatatcgtagacagtatcttccaaaataggtgtatcccatgctacatttggaataacaggttttgtataatctcgtttataacctgtatcactcttcaaagatggcggaaaaattccagcttggttcagtgttaacccttttctaacaaggtaaacaactgttttactagttcccaaatgtgtctgaagttgaccaccttcacctgctcgaaatgcgagggctacataattctttggatcatgccaatagtaatttggatgtctacttgggtcattgatgtccgttggattctccgtattgttagcaatgtaaggtcctatacgaggagccgttgtcccaaatgctgccaagctcgttgtggcactaacataatctgtatctttttctccaccagtaataactgtcctaaactcaatgaactcataatctttgcttgaaaccggttctggtacaacaagtccttgctccttagcttgtttccaagttaagtcagatttcacaaagtatatgaaccctgctcgaatctcaccatttaattttaaacgaccattggctatcgcactatatttaacaggtacatagtctgataaatcaatatttgaaacatcatcacttggagtgtaaatatttttggttggcttacgataaacattatcaaaatcagcataaaaactttgatgttctcttgccatcttgccagactttggcaaagtagcattccaaccgttaaagacgcgtcccttttgttgaagggtctgcggataggcgatgttcaaatcctcccaatttaaatctttacgaaccaaataataaactctcttcgtttttttaccattaacgacaaaattaccaaaatcactatttgtactgaatgttactagaatgaaatttttaatatcctgaagaccttctggacgatacttttgatggacaccattacgtgttaaattttctgttgaaccttctgtataaaaaggtccatatactaattgtttctcaatagcaagatttaccgtttcagtcttaacatcacgctcaggatcatctggcaaactaggatcaattttataaacgtgcgcatggtctccatggcgtacactcatatagttcccatcaattgtaatgtcctcacgttttactttaaaacgctccatgtactgtttaatgagacgttcttttctctgttcaagagtttctccatccttttgtttaagaatacgatcttccggactttcaaatggcttcgttgtatcaatttcctttaataaaacaatatgtgtgtgatctccatgcggatactctaatccaatttgaccgtcaacgatgactttcttaaaacgtgatggctctaaattcagttcttttgctaagtagtccaatttggtttgatactcagtattttctacctcaggttgtgccttcttatccgattcaacatttggtttatactgattcacaagataagaccatttactccttttcaatgtttcaaaatgaataagatgcaaatgtttcccatgccttactagaatcccggtttccgttacaccgctgatattttgcccatcaaacaagaaaccgtcactcgtttgaaaatcaatccccggaatcccttcctgttggtgaacgataggaagagttggcgattgacgactatcagaggtcaattgtctgtgtgtcgtgccacctaagcttgattttaaaatatagtgataatgatccccatgccgaacagtatagccattggcatcctctgcgacaatatctttaggatcaaaaacgtattcatcttcgatctgtttcgagcctgacgataattgacttctcttaggttgagaagaatgatttttttcttgatagttttcaggaattaaataagcccattttgtattctttaaatctgaataaaagaaaaagtgcttatgatcgccatgattgacaataattcctaaatcagttttttcctcaatttgtgactcatcagtgagtaaaaaaccatcatccgtcgccttatcaatccctggaacttcctttttcgaatctgaaggaatctcttttgattgctttgattgcgatgtttctatgcttgttgttttttgatggttcgattgctctctatagttagacgcttgataagtaaccaatgctacagcacaaataagcgatgctcctgctacataaagcaaagtcttaccttgtttcatatctatgtttctctccttatttaccattattatattaccgacacgataaatgtaatcaactattgtaaaatagcatcaccacatccacttattatagtcttttagtttacttttagtacgaggcaatgagccgcaggcataactgaagttaggcaaggcgagttgatgaagtaacaaaagcaaaactaaatgacgataaagttaaaaccgtcgatttatttactagttaagtatatcactcatatcgaaatttagcaagtagtgagctactttccaaaaataaagaacctggttcatcactaccaagttctttacatttttatacttatttagcaagttttgctttagcagcatctgcaagagctgtgaaagctgctgcatcgttcactgccaagtcagcaagcattttgcggtttacttcgatttcggccaatttcaaaccgtgcatcaattgtgagtatgacaaaccgttcatacgagcagccgcattgatacgagtgatccacaatttacggaaatcacgttttttctgacggcggtcacggtatgcatagtagtaagagttcatgacttgttctttcgcagtgcggaacaagagatgtttagctccgtagtaacctttagctaattttaaaatacgtttacggcgtttacgagaaacaacgccacctttaacacgtgccatttaattttcctccaaatgataatctaaattctagtaagtcggcttatttcaaacctgtaagcattgatttgatacgcttgaagtccccagcatgtaccatacctgctttacgaaggtgacgacgttgttttttagttttaccgtggaaacggtgtgaagtataagcgcggaagcgtttcaatccaccagaacctgtacgtttgaaacgtttagctgatgcgcggtgagttttttgttttggcatgttaattctccttttgcttaaaaagcttattttttatctgaagctggggccaattgcataaacatttgacgtccgtccatcttagcgcgttgttcgataatggcaatatcttgggttgcttcagcgaactcagctaatactttcgctccaacttctttgtgggtaatcatacgacccttgaaacggatcgaaaccttaactttatttcctttttcaagaaatttacgggcatgacgaagttttgtctcgaaatcccctttatcaataactggacttagacgcacttcttttacagtgacaacactttgttttttgcgttgttctttctgtttcttctgatattcaaatttgaacttaccgtagtccataattttcgctactggtggtttagcttggggttgaatcaatactaaatccacgttggcgctatcagcaatggcctgagcctcattgagtggtttgatccccaactgttcaccctcaagaccgataagacgaacttcacgcactcggatttcatcattgatgaacaaatcttgctttgctatggcttttcacctcattttatatttttcgagaaaaacgaaacggacttgctaaacaagtccgcactacaccattattctttccgaagaaatcttaatccgtagagccagacaacgttagtcgcaaggcgagaagttctcacttctgcttttctcaatacgactattctaacatgtctaaagctacctgtcaagaatttctttcgctttttcggaaataaatttcactacaccttcgatagatactcctgttgtatcaaaggtaatagcatcatctgctgcctttaaaggagaaacttctcgattggaatctttatagtcacgagccgcaatctcctctttcaaggattccaagtctgtctcaatgccacgttccgtattttccttaaatcgacgaagggcacgctcttcaacagaggcaacaaggaatattttgagttctgcttgcggcaatacaaccgtaccaatatcacgaccatccataacaatcccaccagcttgcgcaatgtcctgttgcaggcggaccaattcttcccgtactagaggaagcgctgctaccgctgatacattatttgttacttgattatctcgaataggcaaagtaacatcctcatcaccgacaaaaacaagttgctgaccgttttcatcccgcccaaatcgaatgggatactgggcaagcaagtccacgattctattttgatctgtgacctctatgccgtttgtcaaggctagataggtagccgagcgatacatagctcctgtatctaagtaagtatatcccaaatttttagcaataattttagcgaccgttgactttccacttgaagctggaccgtcaattgcaatttgaattgatttcataactcctctttatctaatacgaactacatccccaggatgagcaatccaagaccctgtagtcattttctctggattcaaacgctctagctctgcaattgaaatcccaccacgagcagccagttgtcctacaccttcacctgcttgaacagtaagggtagagccatccgttgcttccgctgggctagaacttgtttctgtttctgtcgtgtcagtcgaagtagattcttgtgtctcagcagccgatgaagagctctctgctacgactgttgtagtgcttggggtataaaattcttttgttgaatctgttttactaccgccaccgattgagagatagacagccataattccaataatcagtacgataacaaagaaaataattgccaaaactgtaaatactgttgtattcgctacccccttactcaaacgttctttacgactagttgtttctgtgtggtaaacttcttcattccatggctcttgtgacattattgagaaaactccttgtatttttattaaaatatgattacaatactaatatgaaagtaaaacttattcctgaacggtgcattgcttgcgggctctgccaaacctactcatctctattcgattatgatgacgacggtatcgttgttttttcagacgactcacaatttgagaaaacgattgaacccaatccagatattctcaaagccatcaaatcatgtcctacaaaagccatttcagcggattgatttggctttttttgtataatactcttcaaaataatcctgttttattaaatggtctattaattcaattttacccttgaagcaactatgaatagctaaatggttaataaagtatttttttgtccatttacgcatataatacattcgtccgttgggaaattcttttgcaaatatacgaatggctaaataagaaacttcaattttttctatggtagcaatttcaattttctgcactgcaaaaggattagccgaagcaatccgtaaatgctcatcttttatctcgaaatagcgatgtaagccgagcactactaatacagcaaagagtgagacaagtagaataaataatcttgaaacttgcaacttctccaataaaagtgccataccaataaaaataggtgtgaaggtaagtgaccagtatatgatggcccatgataaatccggttgccaatggtaacgaattttaccaaaaattttgatcatatcggacctccatctattattctagcacaaaaaaagagattttcctatgaaaacctctatcttttgaaattttttattacatttacatgacaatgttgaatgttttgtaatttttctgaaatgtttttgaaatattttgagtaggaattgatgggaatacaatgattggtaactaaaatattttaattattcgtctcttgactcttaacatagtaactcaggagaaacttggcaataaactttggccagaacaacaaatacatttcatagtcttcttgtgtacgaatattgttttcaatgctatttgtcgtctcagattcctcatggatacgatgatacatcaaactctcatctacaaaggtaaagctcccatttttttgtgcaatctgataccaagcaaaccaatcaagagaaactttcatttcttcattaaacttgaaatcattcagtttcttcaaattataggtcacagctggacaagaaattggattaccaaaggctaaaaccctattccgccaaaacttccatttgggaaacatggccattgtccgtaacatgagttgcttgattttcaaatttgaagttaagggaatagccacaccttccttaacttcctggtaatctgaataagcaatcaacgtttcctctgtcatctgagacattattttttcacaatagtctggtaaataaatatcatcttgatgagcaattgtagcataaggggttgttacaaaagagagtgccaaattccaatcttttccaatacctcctccttgtgcggtatgcattacgattgcattcttttggcaaatttgttctatatattcactcggagtactagtgtataggatgagttgtgattgaagtgtttgctgctttaacgaatggatgcattcttctagatacttactatctccataagcacagataacaaatgtatggttattctgcatgatgctcctccaattcagagattctttttttagccattgatacttcttgaattaaatttttaatctgctgcttttgttgagataaagccatactatgcaaaaatccaattaccaagagaacaaaaattgccacagataacaagaaattggaagtcagaccaaacccgaataagtaggccaatttaataggaataacatcaaagagtgcaaaaacaatcagtccgaagccaataacaatccacataaaggcatgttcgaataagatcttatttttattaatattcctaaaaataaaatacaaaaaacctagcgaggcaagaaacatagctaatgcttgtatagtcattattccccctccttcataagcgaagcaatcaaaatagatgagcaaacttctaccatgtagcggatggacttaaatggagtaatcgaagaaacccctcccgctctttcaaacatattggccggtgcttctactacttggaaattttgctttagtaaatgaacagttgattccggttccggatatttaattgggtatcgttttgcaaattgtgcaatcacttttctatttcccaaacgataacctgatgtagtatcccaaattcggtttccagttgttaatttaatcatatttgaaataacacctatcccaaatcgtctcataaagctagtttgaaattccgacaaagtatcaccaacaaagcgtgagccaatcaccatatcagcctgaccaactaagattggctgaattaagccatttaatgaacgaatgtcatgctgaccatcaccatcaaattgaactgctacgtcatagtcattgtccaaggcatatttatatcccgtctgaacagctccaccaatacctaaattttgtactagatgaacagcatttaatttattttgaatcaaaatttctttcgtgctatctgttgaaccatcattgatgacaacataatccaattggaaattcacactatttttataatctataattccctgaacagtttgaaggatactttcttcttcattgtaggcagggataatcattaatactttcattttttctctctaaaactagaattctatataactttttagattctacttactcatttgaagaaactataatatacatctttcagcatagctatcctattattcattaaagtcgaagtttatgtctgatttttgtcgccatattgctgatcaatcttgcataacgctccaatcttgttggacgcatatttaaagtcagtaactcttttatgtgacttaaatttgtattttggtgtccagtatattctaagtgattgatgccgtccagtatttctttataggcaacttccggtgtatatagagtacgtaaacgttccacatcaagccgagccctatctgaaaaatttctaaaggattcaatcacttgctctaacttagtcaccaactcttctatatcgcccaatttataaatttgacctgctgagaatatttcaaatgccgtcaaatgtcccaaattatttgatagaattactggaagccctcttaagattgcttcaacatagactaagccaaaagtttccatagatgaggggaaaacacagatatctctatcagttacttcctcccaaggattatctaagttacctaaaaatttaacatttttctgtaatttattttcatggatatattcatcacaaatagctttgtatttactatcccatcctccaataaaaaccaattcaatgtctaatctatttagtgtcttatatgcttttataagttctaattgattttttccttctgttaatcgaccaacagaaacaattctaacttgattgcctttttttaaaacttttgtttcttgctcagtataagaaataaacgaatggactttcttattaaatagtggtgttaaaaaattatttaactctccagtcacactaaataattctgaagaatactcttctatgaagtcaattttatcagcataataagcaaactcatttttaggaaattcatgaattagccagaaatgaggaaccttttgacatgaggcagcaattgctccttgaaaaacattaacagtatttgaaataaccaagtctatctcattttgctcaataatttcagctatgtcttgaacattctggcgatagtagcttgtggcctcttctctattaaggatttctccacctggtgcatccggccaccaccacttaatagttggcaaatagtaattcttaacccctatcattttataaagttgctcatgcttatcttgtggttcccctcctattgcatgagtaacatttataactgtgtgtcccagttgaataaggtacttcattagataataaatagacttctccgcaccattatccatactagtcgtaggagaaataaacaaaatacgtttcattagactaactcttctttcaaaaaatcattaattctatttgctgtagtgcaatgattcattacaaactcaaaagcattttctgctatttgtgctctcaagtcttgttcaagaatcaatctctccaatttactttcccattcgttatcatctgctagaactccagtcactccatcttgaatcatctcttcaaatgctccaagattacttgcaactgtcacaactttaactgctgccgcttctatccatttaatttccgactttgcttcattaaaggttgtggttacaagcggcgccaagttaatatcaacttgtgaaattaaaattggaagctttctccaatcaacatactcatgactcacaatctgttttttgaatttttggaatggtttcggaatgtctaaatatcctactatatgtaattccacttgcgggtacttttgaagtagatttagcaatgcttgactaattaaatcaaaattttcgttgtgtgtaattgaccctgagaaatatcctattttaactttattgtcgttcgaatttttcttaacttgtaaactacgctcaactaattctttagacatgacgttgcgattcaaaataaccttgtttttatattgttcgagctcgtctttcaatttcgaagtcgatgtgatagcataatcgcagagagaaagcatttttttgtaagctaaaacacttgtatcatagccttttttctctctcttgctcaaaccttgggtaaattcaagttcatctgtaaattttgtatcaaaaaccaaatcatcaatatcaaaataaacaggtctgttctttatgtgtgctgccctacatatttctttcagcatatcattgaatggagcacgataaataataatatgactagcaaactgtgcatcctgaagttgtacaagagaattatttatcactcgaactgtataaccaagttctcgcaattgctcagccttatttaacacacgataacgtgtacattgtggaataatattttcgacaccatcaataatcaaaatataagattgattttctctagttttaaaatcttctaatatagaagacaccacttcgatcggatagtctgtttccttagcaatatactccatcaaatccggaatctcggattctctttctaaaccatgccaaaaatattgttctctgtcataatttctaaaggccgaatacttaactaatggacaaccttgttttaataatttaaacggatgaatatacaatgcactatctttcgtgtctttaatcaatgcatcatacttaaagcctcgatcataaaaatattttgcaaacacagtttcatgttttccaattgccttattacgagaatccgtatcagagagcttttcccaataatcataaaatccttcatacctaagcaagctattttcaataacaacaaaatatgattgtaagtgcttaggaattttaccataagggttataaccagtaaagtctagctgctcctcacccatggaaattccccaaaagtctagctgatcggaattaaactcagagaaaacctcttccaaatctctaaaaggaccaatattcgtatcattaaccaagatgagctgattatattgttgtaacgcctcttttccagtatgtattatcccgtgtcggaaagccgcaacgtcatagccctcattatctctttccaaaaccttaccaaattgtgctaaacgatttatatcagcctgtggaagtttaccatttacaacaattaaaacatctcgagaaattttagccaatgcctctaaaaaaattactttatagtcctgtaaagacgattgatgttcataaattgtgtaaatcaagtaacgatttttgatatctgaataattatttctacgttgcttatcacgttgcaaagctagtagagttcgctttatatattttggaattctccagaaaaactttgcaatatttttggtaagctctaatatataaaacaatagcttgtatttacctgataagataaataatcgcgttgtgaaatttctaatccaccttttcacagtgttaccaatcactttctattattatctacttttataaattttcaaaagtttgttttgaataaatgttgatacatatatccccagaactctggtcattaaacctgagattctaaacgaaacaagttctaccttctgtgaatattttagcaaatatctaaattttttcacaaacatttttatatcaaaattattcagatatggaaatacaaatggcaagatggaaatataagaatttgataaataaatcaaaagtgcttcttgtttctcattcgatagttgtttaaaattctttaaattttcttcaattcctctaaaggcatgttctacatgtcgaagcgtgacattatttgtaatacttccttgtcggttctgacgatacatgcattgtgtattatctacaacaataaatacattcaactctttcaagagatttgcacaccaaataccatcttcatataaatatccactcaagaaattaagagcagaggtaaatttatctcttctgacacacttattccaagcaggggtgattagggctcctgtttcaacgagtaagcgcgtatctgtaataacctgatgaaacggtaattttttagaaaaatttcgaactgctacatcatccttaccgtaaaagtaggaaaatggatagataactgcatcaataacttcatcatgtgaaattatttctctattaacttcatctaaaaagcatatatcggtccaaaagtcatctccatccagaaataaaatatagtcaccactagcattctttatccctgtatttctggctgcagataatcccccattagtttgatgaaataccttcaccctatcatctttagctgctaatttatcgcatatattggaggttttaccatctgtagaaccgtcatctaccaacaatatttcaaactcttcataagtctgattcagtacactatacacacattcttccagataatcagcaacattgtacgctgggataataacggaaaacttcacacctagactcctttttgtaatctaattttcctatatttcatgaatacaggaattaagactgtaataattttataacgcaacattggaaaaggcttcataaccatgttaaaaagattaaaacagaaaaagtaaaactgccaaccactctcaaattgagtacctctccatggcgtctgatttaatgcagaaacatagtcctctctaaatcgatgtttatttccgattctccatggacgttcttcacctaaaaaatgaacaatacgtggttgcttacgaatttttacaaattcttcttttgaaataaacgttgaaggcctacttaatttttccaacgtacgatatggataaacatcaaaaatattaaaataattataagtgattgagagtgtttttatctcttctttcaatgctccattcagtgcatcttgatcattagcaaaaagctctccatttttttctttataataatcaaaaataattgttcctatactttttgaacgccaccgtttcaaatcgattagaagaactcccgcattatgatatgtatacgtacccaaatttaagccttctcttctctcagatgaagctgtcggttctgggcacattccaaggactttcccctccaaatctacttcccatagctcccgaatattttctaaaactaaagtatctccatctaaatagatgattctatcaacttcttcgggcagtaatttatctacaagtaatcttgcaagtacaaccgaagcccaaccatttgtgtcaacttcaaaatcaaaatatgattccaagttttccaattcaacgattgtcaatttatttcctccgtcggtaacaaattgatgaaggttttctttattctgttgacttataccatctgagaaaagataaaaatggcatgtatcgtcttcgtctaatgttcgcatgattgagcccatacaagctgcaacttgcggaacaaaagcatcattcaatgtaaataatatattcacgtttccctcttccactatcttcttacacccaataataatccactatcaaaaatagatacatgataaagttaatgactactgtgccagtgagcaaccgtatcaaatacttctgttttaccgatacacttacctgctcttttaacattaaacatgccggaaatagatagactaaaaacggagtaaagtatcttccttgtgccccttgagaaatcattgcatttggtccaatagctgtcggtgtccaggcaaaatacatgcccgctacaatgatagctacctgaacagggagtacaaataacgacgcaagaccttctgttttacttatctttaaatttccatcattaaataataataacgtaaaaatgaaaatatctatgaaaattaaccagagaggtagttgagtgacaaaccagccaaaataaccaaaaataccaaccgttaaaataccattaagatgatcatttctattattgataaataaactgtttatcatcactttcacaaagtgcacgacaccacctctattatgtaggaatagatagctaacaagtaaaactagtccaaaccctaaaataagaattggtaatcttctcttttgaatccattttaaaatcgaattaaacttagataagacgccttcaaattcaaaatcaacaaaaaacaatagtgccaaaagtaaaatattatttgcttttgttagatatagtagcaaggatagtaatattaagttaataaatttcctggtggtcagtaccttgtctaccaataagttaacataaaaaacaaaaaatgcaacaacagccagatagttcaccacatcataagacagtgagccagcctgctgaatcatcataggtaaaagtgagacaaaaaacagggtcatcttcccatactttattttttttatcaaatagtagatacctataatatagactattgtattaaaaaggcgccctatagtgaccatcataccatatgacggataaagcaatttacctacaactagaccaattagctgaggtgtactcattaacgatttcagagaaaaatcgatagataatttgtcctttgaaaaatcacgaattttggtaaaaaggcttgaatattctgtagaatcaactgcatgaatctccggttctgaatacgtaaaatctgctgcccgtaattcattcattgcctcagtatctctacttgtcggagaatcaaataatatattccacgacataaaagcatgtgttgcttcatcaggaacctttgtcacaggcataacaaatattgaaattaacaaaaaggggattgctaaccttaaaaataatttttctatcttcattcttgtacttcccaattcaaatgtttttgcaattttagatatattactaaagaaattaaaaaccaagtccacatcgaactaacaaaagcaatagctgcccccaatattccataatattctaccaatggattagaaatcaatatggataataaacaagaaattgcaaatgaaattacgagatacttttgcttcctcaaaacagtaagcatgttatcacaaatggttgcaaaggtactcgcaattcccccaagcattgttataataaagctgagccagtatttattaagattcgttccgtagagaatatttaatgctggaatccccaatactattcccccaaccaaaactaacacagccaatccgacaaccattttaacgatacgcttctgatattgtttaaattgattatagtccccagctcttctatatatagccaactgagttatcatgggtctaaacaaaatcaacaaaatattcattgaaaaaacaggcataaataaaatattaaaatctctttgaacacctgttcctataacacctctctcaaaaaaagtattgagagcatatttaggttgattatagatagtaacaagtaaaaatgcattaataaataacggcaaacattctaataatatatttttaatggctttcaaattaatttcttctttgataatcctcgtaaattgaaacaaattcgtaacatcaaaaaagaaaacaaataaatatgagctaattactagatagattaatgagagtagcaggttattggttataaacaaaccaaatccaaatgtcaaaatcacaatagagtttctcaaaaaaagtgatttacctgcaatatctagccgagcattttgttggaacaatccttgaaaaacatccgatagagcatcacttccacgatacaaacatattaggaaaatacaagcagatttttgaaattcatattgagacagaaaaatatagcttaaggcaagtaatagcataatagtgattgttataagccttgttgcaagatactggctaaacgaaaattttttcgaaacatcagtagcttgataatctcttacctgaaaactagcaatgattacaaaaagatttgctactgcataggcaaaactaaaaatatcagcctctaattccgtcaacaaacgtgttactagtaacaataaaaatattgatattgctgctgaggaaacacttcctaataaattccaaataaatattatttttggtgatactattctgctcttcacactttcttccccttgtttgtcatccgttatccctaattttttaatagagatttctttatcatcttaaacacgcttacaattccaactgatattatctttagtgtccttctcagtccaatttgtaaaaattccttctcttcaataattaaacgcaattctctttcactagaaaaactaatcttttccaatattggactcacattttcagtattctcgaccactgcataatcgtttgataaatcccacgcgctataaataaataatattggaactagcaataatctatcttcttttgaaaaatcaatgtttctaaatttctcctcaatctttttatagtgttctgtttttatccaataccaacttacttcttctccaattatataaggcactttataaaaatcaactttcttagttctcacaagtgattcataaagtatattcaattgacgaataagttctggattgccctctcgaagactttgtctatcatatctttgattagttgttaagtctggaataactacagccaaattagattgtgattcaaaattagaaatcactgcatcaaatgatgtaaaaaacattttcctcaactgatgcctgtcaataatatcctctacagaatattttatttcctttgtttgtttgacagttacatgagcaagatatttggcatctcccatatagttgtttactatttcaaaaaaatgcaattcatctgtgagttttgcaatctgtgctctcaattggtaggtgaataaacatctctcaactatactacacttatttgaaaaatcagcttctggcaatgttattagtaactggcacctatcggctattttgcataactcttcaatatactcttcaaaaatagacactgattctatgtgaacatgaagaagtaccgacgtcgaagaacgaacggtctctgtcgtttgcgaaacccgtatttgaggaataaaactcgtacccggaatgattatctgcctcaaatgcctctcgattaattcaactggatatttcgttttcatcctaataagatgtaataaagagtatattctgtctggatattcggtaaaactctttatttttatgaatggaacattatttttaagtataacttctggatattctagtgtaatgttgctattttcaagggttttacaacaaatggacgtatctaatgcacacttatagctatagccctctgataaaagtatttttgtcaattggctctcatataattttataacatcttgaatatctgttaactcacttaccgatgaccaaaaaccaacaaatgcttgactctgcaagattcgttttttaaataccataaaatatgactgtaaatgttccgggacaactacactatctatttttgtctctaagtgattggtcatcccccaaaaatctacatcaacatcactgtcaaattgactataataatcctctaggtcccagagggggccgaaacatgtatcattcatcagagttaccgaatcatattgataaaatgttacttgattcagcccttctttccatgccgcaaaatcataaccaatattatctctttggataaaaaaatcaatcagtcgttccgactgtaaatattgtactatgtcctttgaaacatggctgttagaaacaaaaactatgtctgaataaatacttcgtatcgactttaattgaaaataaatatattcactaacaacattatatttattatagtgaacatataccaacaaacgcgacattctgcctccgttatattttattaatctagcagctcccattggctatttctctgaataaacccggttgctgcgtcttcctctgcaatattatcagtactaaacttcctactaataaaaatagccggtgtgtcagatgtcttggcaaataataacggctgcttattactatttcgtactgacaccgccatttttaattttgcctgattaattgaaggtagcttacatttcactcggaaaaacttctcgcctttaccaaatgtttttaaatccatagaattgtcgttatatacatcaaaatgacgttctaaatctaaaaatgtaaatgcaacatgtgtttcaatatcttctaaaaccgtatatctaaactcgatttcaattgattcatctggttcaatttgattttttgagaccaggttaatctgcaaatcttttacaatatcactctgatgcagaggttcttcgttttctgtaacttcgcttattgaggcaagcacattatcaaaactgtattgattagctacatcatcaggttctcctaatgccttgacgtatcctttctctataagaagagctttattacaatactttttcacagctcccatatcatgggtgacaagaatggttgtttttccactttttttacgctctaggaagtaatcattacatttacgctgaaaggcctcatcaccgactgctagaacctcatcaagtatcagaatatctccttgagctttaatggcaactgaaaaggctaaacgtacctgcataccactagaatagtttttcaacttttgattcatgaattcactcaattccgcaaattcaacaatatcatcatacattgcatcaatttcttctgcagtaaatcctaacatcgcaccgtttaggtatacattttccttaccagttagttccggattaaacccaacaccaagttcaataaaagaaactaatttaccatccacagctacagtccctctttcaggaacatatatttgagataaaatttttaacagtgtcgacttaccagaaccattgcgaccaacaattccaaaaaagtcccctttttcaacttcaaaactgatatcctgcaaaacattatactctacgtagcctttaatccctttaaataaattaactaaagtagttcttagactctgactactctccgttggaagcttaaaactcttgctaacatgttctacttttacagcaatattattattttttaccattacaaaatctccgcaaactttttggcattttttctaaacacagttatacccaataggtaaacaacgactggaagaatatacggaattgccacaataacaggattttctatcaattcactaactgtagtattcccagaataaacaataaaatgtctcaagtcttgaataatttgtgcaacagggttcaacatcatcaacttagcaaatgttacttgcccacgctgtaaaataaatgtcaatgaataaataattggtgtcgcatacaatccagcctgtaagaacacttcccaaattggaccaatatctctaaatcttacaaataaggaagatagaatgaaagctatacctgttgctagtaacgccaattcaaaaaacaatgggattataactaaaacggaccaagtaaagggaaccccgttaatagcagcaaatacaaacacaaccattaagttaatggcgtaattaattgcagctcctgcaactgaagaaaagacaataatttctttcgaaaaattcaatttacgcaacaaatctccgcgtgaaacaatagacatcatccccatattagttgcttctgtaaaaaagttccatgttaccatacccaatagtagccctactgcataatgaggagttccatcatcaaagcgcaaaaaacgaacaaatactaaatacataattgtaaaaagtaacatcggtttcaaaatcgaccagagatgcccaatgagagaaccttggtaacgtaatttaaaatctgttttaatcatctctcttaagagtatttgattttctttatttaataaattcataactattccttatatgcaaattttgtcacaatcagtgttgtgaatactaatgtatggaaggttttgttttttcttaaaccatattttctcaaaatcctgaatcgttcaagcattggtttatccataatggttacaaaggcttctattaattctctatttgattgagaaaggggcatttgtaataaatgccgggcttgtttttgactatttttaatcaagtcccaataaactgcaaataaaatatgagggcgaatccattttttaaagcgttttgagagtgttcgagcccctaaaacattatcagaatgctggcgatagagttcgccaggcttgtcaataaaaaccagtttacccaaagccgaggccaacaaagctaaataccagtcatgcatcaaaatatcctcagttacttgccacatttcagcaagatgatgattaatcatggcgacaccgccagttacagtattctcagtcaactcttgcaccaattccgtattggcatgatgagattgagattttaccatgctttctgccataacttctagattttgattgacaactttgaggtccatataaaccatcaatggcaaatttgttggataggcttgtgcttttttcaggctaacttccagtttatttggtagccaaacatcatcttggtcactgaaaaaatagaaatcagcagtatcataatgaactagcctatgaaaacttttgatgacaccgagattttcgtctgtctcaacatctatgaagtgaattcgctgatcttgttcaacaaaatctttaataatctctctagttcgatcactggaaccatcatcacgaatgaatagtgtccagtctatgtatgactgttcttggatagagcgaatttgctcagctaagaactgttgaccattgtaggtcgacatgagtatatttactttcattgtaaaaataattcctcgtactcttggacgattttttcccaggtgtattcatccttcatgtgttttttcgcaatttctcctaattccatcgcttcagcattctcatcaatttggttaattaattgactcaggctacctgactccttactccaataccgagcaccttctagggcaactttgcggttaaaatcaacacctaaaaccaaattttcattggtttgcgccagcgcttctaggagactaggattggttcctccaacttcatgcccatgaatataagctcgacattcttggcgcagatacttaagtagttcttggtcatatactgttcctacgaacttaatccgcttatcggatataaagcctgtctcatctttcaatttttgaaaataggcagagccttcatggtttgcaacgatgactaaatcacgtctcgtgttacttgccataaactccctaattgctgtcacatagttattctcaggtacaaaacgaccaataatcagataaaattctttctctttaatgttccaatttgtaaaatattggcgaacttgctcagattcttttgttaacttagtcggacttaaatctgtaccataggcaataaagcgtgtattggtagccgagtattcagattgaatataatcctcaattccctcattatcagcaataatcaaatcagcatatttgaccatcattttttcagaaaattttagatacctttggactggcttagcccacttggcccgtttccattccaaaccatctggattgacaaacaaggtacctccaacagagtgaatctgtttcgcaaaaggtactatgaagccacctatggtatttcccaagatatagaaaattggtcgctctatctgctgttccttaatgattttaagggcataagtgatcgccatcatatcataagcaatcacacgagccggtccaagttttggtggattaattgtgaagcaatctgcacccaggtaggtcgaatgttggtgatgacttgtatccgataaacaagccacatgataacaaatcttctcagattgctggtgactgaccaattgttggacaaaggtctcaaagccaccatattttgctggcagtccacgactaccgataataaaaacgtgtttcatgaatcctctccatcaaattgcagttcttttcattataccattttttagttttttttcctaattctatcctagtttggttataaaggcttttctttttctacgcctctgactccacagtatagataaaaacaaattttgagttaataagaaaaatttgatataatatgtactggcttttacataaaaatataaaacttagaattgttaataaatatgaaattaatcaaacagcttattcacatactaatctccatcggattgattggaagtttttttctctatgcacacctcattcaaaacgaattaggttctacaaaaaatgatggaactatagaaataatcgcagaacaaccaaaccaagtaatcgacagcatccaaataaatggacgttatattcattcatcagaaattatagaaaaccaatggggaatcaatgacgctgatttaattcccaatttttcttctctaggtgaggaaaattcactcgtaattaaatcttcctcttctgtaagaaccttatcatttgaatactttgttagtgaaaatccgactattgtaaaaattaaagtcggtggacaattggttgaatccattgacacatcaactggagataaatataaaaatttagcctttattgagcttccctatactttacggataactaaagataatcaattttggtacctccacttaatagtccttgctttaggtctaacatgctttatcttaaatggagcaacatggagaatcaaaagaagagatatccgtatcttaacaatattattaatcgttcaatatatattcactacttttacatttccacgtttatatcgcaatgaattagtgctatttaattcgaactttaataaaatggaaactcaacagctattagttgcactgacttaccttatattttttagtcttttgggatacaaacaactccgaggtcatatctctaaagccttcaaaacgattagtctatcagtaatttatcttctagttcccattttttcattatttattattgaaaatagctactcacaattctctactctttcctccaatagtctttggaacaatctaatcattatcggagtcctctacctaatactggtctttacaactaacttacgatttgccagcctattaattctatccgcttcagtatttattggtataagtaaccaacttttgattgacagccgtggtgctcctctattattttataatctttttcaaatcacagacggattaaatgtagcttctagcgtagcaattaatatcaacaatcgaatgctacaaagtatggtattttcttatatcttattgaccttctttttctttatccccaaattatatttaccaaaacttctaccttctagaacgttttattctagttatgatttcaaatggccgaaacgtttcagcagaattttactgggctatataactttaataacaatcgttccaatgattaataaaactgtcgtctctaatgcaaatatatcattaaactactggagaatgtacgtcacctatggtcaatttgggctaccactctcactcgcctctttctatgaagatagtaaaataactaagcctgaaggatactcagtccccaaacttaatgaagttcttgagaagtaccctcctgaaacagaaaaacaaacaatcagacctaatattatctttatacagaatgaatcacagagtgatttttcaaacttacagggcttaaatatggagcctaatccgctatcaaaccaacatgctttaacagacaatactattcatggcaccctcaatgtctcagtctttggcggtggtactgcaaataccgagtatgaagtgctgacaagtaacccaatcagtttattatcttctaatttattcccatatcagcagattatcacacaagaccgtccaagtttcgcaacttatctaaaaaataaaaattacgacactgtagctctacatcctcaatccggaaataattacaaccgcaatgcagtgtatcctctactggggtttaataaatcttattttttagattcggaacctgctattagtagcttagcaccactaacaatcgatcgtggctggccatctgatcaattcttgttcaacggaataaaagaactttatacccaaaaaggagaccagcctctatttagctttgttgttaccatgcaaggacatggaggctatccaagtacggaagaaatttatcctcgcgaagtcagcattaatggttcaacatctgaatacttagctgaaacagaatttttgaccagcatgaaaagaacagatgaagcatttgcagatttaattactttctttagtacttacaaagagccaacagtcatcgtcatgtacggcgatcaccaacctagtttgactcaggaattttacgcacaatttatggatgaaaataatcctgccgctaaatattctacccctttagtgatttggtcgaattttgatattagggagcgcgaatctacaacaatcagcccaaactatctcgttccatatttgatggatattttatccgaatccgactatgcccttcctcgatcaccttaccaacaatttttgagtgatatgcaaatcgaagcacctatcattactagctggggaaatatcgataataatggccaacaaattgaagacctatcaaccctaccactttaccaaacctacttacaactagaatacaatagtgccattgacaaacaacctttaacagatttatatgagtgataaaaatagccttgctcggttttgagcaaggctattttatcatcaatcacccaaaaaacttaattatctaaaagataaagcttgtaattctcgataattgatcgtaatttttcaccatatttcggatcagtagcatatcctgattgtcttagcgcaagaatcgcttgttgataatcagttgcctctctgaaactctggtaattttttattctccacggagtagaggtaaagaacttagcatagtctgctacactttcattccatgaattatattttctaaacaagtgcttttcttgcttcttctcaccatcacggtattcattggtaatgatttcaattgtagcacctgtccacgcagcatccgctttgatgccaaaaagattattcccatgagtcgccaagtatgacgttccccatgcactttcgaggatggcttgagataacatgacgctcgaaaggatagaattagcttttgaactttgttcaattgcaggtactagattggctatgaaacttttttgatcattagaaagttttcctgtttcaatacctgtacctgcaatttctactttccctcaacagcaccataccaattcattacaccttgtgccaatgctttcgcaaggcgagtgtggtaagaatcttgtttgataacttgcaactccgaaggattatccataaatcctagctccactagaatggcaggaattgctgtctcgcgaaggactgcaaaagtttctcttcttacaccacggttaactgcacctgtttctttaattaaactctcctggaccttgttggctaaaatctcactttcagctaaacgagtagggttattatgcatttctttattaattttaggttggtattctggattatattgataccaatatgtttcgataccagtcgcattcgaaactcctgcacccgtcgcattaaaatggatactaataaataagtctgcgttgcttgcattcgtcattcgtgacctctctgttttgaagtctacatcataatcacctgtacgggtcatcaaaacattgattccatattgcaagagattttcacgcaacttatttgaaacagacaatgcaagatttttttcatgtacgccaccgtaagaagcacccgagtctcgccctccgtgccctgggtcaatatagactgtgtaggatcgctgtgccgacggatttgataaatgagtcgttgtaccacctgcacctgtcaaaccaccatttgaatccttataatataagtgaaccgtgtaggtacctgtacgatacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgattgtacctgttggcttcgcttctgataaatgagttgttgttccacctgcacctgtcaaaccaccatttgaatccttataatataaatgaactgtgtaggtacctgtacggtacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgatggtacctgttggcttcgcttctgataaatgagttgttgttccacctgcacctgtcaaaccaccatttgaatccttataatataagtgaaccgtgtaggtacctgtacgatacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgatggtacctgttggcttcgcttctgataaatgagttgttgttccacctgcacctgtcaaaccaccatttgaatccttataatataagtgaaccgtgtaggtacctgtacgatacttatggtccttcttattaacagttaacttataactgccatctgactgacgagtagcttcataccaacgtatatcgtctgactgggaccaggtaggtaagagaacacttgctatatctttcggtgatgaaacattagtaacacgaacatcaaaggtaccttgggcatcattacgattttcaattgtgattgtacctgttggcttcacttctgataaatgagttgttgttccaccagcacctgttaggccaccacttgaatccttataatataaatgaaccgtgtaggtacctgtacgatacttatggtccttcttattaacagttaacttataactgccatctgactgacgagtggcttcataccaacgtaaatcatccgtctgtgaccaagtgggtaaaataacacttgatatatctttcggtgatgaaacattagtaacacgaacatcgaaggtgccttgggcatcgttacgattttcaattgtgattgtacctgttggcttcgcttctgataaatgagttgttgttccacctgcacctgttaggccaccacttgaatccttataatataaatgaaccgtgtaggtacctgtacgatacttatggtccttcttattaacagttaacttataactgccatctgactgacgagtggcttcataccaacgtaaatcatccgtctgtgaccaagtgggtaaaataacacttgatatatctttcggtgatgaaacattagtaacacgaacatcgaaggtgccttgggcatcgttacgattttcaattgtgatggtacctgttggctgtgtaacattgaccgaactggaagctgtactgactcgagcacttggaacacttgtagagccattcgaacttcctgcaatcgtatttgaagaacttcttgtcagcgaattcgaagtactacttgttgcacctgctgtcaaactagaattaaccgttgagcttgtagtagtcgaagttgcttcctcctcaattttagacggagttgcatcactattatccaaagcagtaggcttctcagccgcgcttacgacatccttcttccactcgaaactataatctgataaggtctgaaaacttccatctgttaattgtgctgttaacttcagcgaaaagacttggtcttcctccgcaaatgcagaccgatccaaaaccgctacgtatctaccctgctcatccattgagaatgtgacagtaatgccgctatttgtttcagagctaaactgggctgtaacaccaataatttccccttgaatgttcgatagaatagctttaatctgaccagcctcatcaacgacagataactgcccgccagtttcagcaacctgagatgaagaaacttgactagatggggcatttaccatatccgcttgaacaagctgagcattcaacgcggatgcacacaaagaaagaaataataacgttctttttttcacaaacatctcctttatgtatttcacatgtaaaaacaactatatttctcaaaatagatgcaattacactaatcttctatttttcttcttgcttatttgtcaataaccaaccagcaaaaattgttatgagtcctagtacagttaatggaagactagatttccctgaagtttttggcaataccttagcattatcatttgggataacctttttctgacctgcttcggaaatattgcctttgcctgtagctacatcagaaatctgaccgcccccttgatctggaacggtctgcaaatcatttgagccatttgtagcgctttgacttgtttgtaccccggtattttcagtcttagctgtacttttatcctcgacttttgattgtagactagcagttagttctgcaatctgtcggtccatttctgaaaagtcatacggaaattttggttgcgaagcagttgcaagagcttgaccatatcctatagttgcagatgtaatagattctaaattagagtttccactttccaataatccagctaattcttgtccagttgcttctgcataagcaatataattatcaatcgctgccgactctttattcagtagttcaacgataacttctctagcgtatttcaatgcagccaattcggcttcaggagtacttgcatcatcttcagactcgtacttagaaactatagccgccgcttcttctcttccgctttttccagcgactgtaagtgtctcaaataagtaatggtaatgttgggctatgctaccaattaaatttgcttcgagttcatctaaaacaacaacttgctctgctgttaagtttgccttcaagtctgcaatttcttcatcccacgcagcttcagcactacccgaagccatttcttccatcattccctcaagaaacgccaatctatattcttgcatatcgatagtcattttagcttgaatatattcacgtacggcaactttttcatcatcagttaaatgataggtcgtactttgacttgtctctgctgctacaactggaacagctccggacggtaatgtagcacctcctagtaaagccagaaaaattcctgacatcaacaacggcttaacaatcgctttctttttcatacacatctcctgtagactatttcttttcttgtttatagaatgcttccaatgcttcttgccaagttgggatgacaaaacctgtcgcctttgccttgtccaagctcatggttgagttgaatggacgttttgccttggctgggaactggctagaatccactggcaataccttggtgttggtatccttgaggacttccgtcgcaaagtcaaaccaagtcgtatcttctgctgcatcgtttgacaaatggtagtaaccaaatgcttgcttggtgtccaccaagtgtaccatgaattccgcaagggtacgggtccaagttggacgaccgtgttggtcattgacaaccgtcaaagtatcgcgggtttccgcaagattttgcatagtgaaaacaaagtttttaccgtagttaccaaagacccaagctgtacgaacagtgtagaatttgtcagcaaatttctcaactgcttcctcacccttgcgcttggtgcgaccgtattcagattgaggatccggttggtcatctacttgccactctttgccgactggcaaatcaccattgaagacatagtccgttgagatgtaaacgagggtcgcacagtatttagcggttgccttggcaacattttcagagcctgttacgttaatcttgtagttgagttccttgccttcatcctctgccatatcaacagctgtgtaggctgcacagtggtatacaacgcttggctttacttctgcaaagaaggcatctactttatctgcatccgtgatgtccatttctgctacgtcagcggcaacgtaatcaacaccacgctcatccaagagataacgcaattctgtacccaactgaccatttgcacctgtaattaaaatcatatttgctccttatttcaagaaaggcttgggcaagagccctagcctttaataatcttatttaataacttcctgtgtcttagcatagttggcttcaacagcttctttttcagctttccaccagtcttggttatctgtataccactggatagtctcttccaaaccttgagagaagtctgtgaattgtggtgtccaaccaagctcgtcacgaagtttgcttgcgtcaatagcatagcgcaaatcgtgtcctgcacggtcagtcacgtggtcgtaagcatcttttggttgacccattttttcaagaatcaattcaagcacttctttgttgttcttctcaccgtcagcaccgattaggtaagtttcacccatacggccttttgtcaaaattgcccaaacacctgtcgagtggtcgttggtatgaatccagtcacggacgtttttaccttcaccgtaaagttttggcttaatacctgccaagatattggtgatttggcgtgggataaatttctcgatgtgttggtaaggaccgtagttgtttgaacagtttgagatagttgctttgacaccaaatgaacgcacccatgctttgacaatcaagtctgaagcagctttggttgatgagtaaggtgatgacgggttatagttggtttccgcagtaaatttctcgcctggaccttcgccatgacctggcaaatcttcacgcaaaggaaggtcaccgtatacttcgtcggtcgatacatggtggaaacggatgtcgtatttacgagccgcttcaagcaaagtgtaagtaccgataaagttggtatggataaatgggcttggatcgttgagagagttgtcgttgtggctttctgccgcatagtgaacgatggcatctgccttagcagccaatttgtcaaccaactcagcatctgcaatgtcgccaacaaccagctcaacacggtcaccaagaatagcttccaagttagccttgtttcctgcataagtaagtttatccaaaacagttacgtgaacgtctggatgattgttatatacatagtgtacaaagtttgaaccgatgaaaccagctccaccagtcacgataatatttttaaattgagacatttttttctccgaaaagttttttacttttttgtgtgtcatcttaggtagtggggtcgtaagcaaccgccaaggtgtttcattactaaaccatgagcctaaggtctcatggtttcccccgctccttagcaaagcaaaggagcttctcactacggcgatgacacacagaactgctcgcttcgctcgcttttttacctcaagatttccttcaagtaagcaatcttagcaaagtctttttgattgttattttctgcacggtaggaatcttttgaagaggcttggtagattttcaggtattgttcaagtgtcggtaggtaatagcgaacacctactgtttctagttcttccaaatcttctagctctacaccagcaaattcaggcagtgaatgtaggcctccgaattcaacagataagccgtctttatgaaattcatgttcatgacgatcaaccaggacatagccaagttgattcatcagaacaatcagctcatctgcacggtaaatccgctcctcatctggcgcttcccatccccgtgggtcactgggcacatgaatatcaagatcccttgcctgccaatctcgtcctgtccgcctttccagaccaacagaacccattaacaagggagtgattcctaacttgtttaactgctctgctatttccaaaaaggcttgaaacattagaggtcctcttttctcaaaggcttgacgtccttgaggaatgggtggttttcatctgcttctgaaacttctgcttcttctaggttttcccacttgatgtcgaggctagggtcagcgtagttgacgaaagcatacttaggcttgagttccaaagcccagtagtcgttaaccaagtagctgtaagccacgaaatctgacaagacttggaaaccattggctactccgcgcggaacgaagatactttttgaagcatcgataacggtttggtaggtattaccgaaggtttcgccttcacgtagatcgacccaagttcccaaaaccttaccgccgtctgctactgaaatgtatttatcccaaggctctgcgtgaagaccacgaagaacgtttttacgagagaaggaaacattattctgcaattttccttctgcaaagaagctttcaggaaagccgagaggcaacattttttccttttggaagttctccttaaaccagccacggttgtcgccatgaacaggaatgtcaaattctaacattcctggaatagcttcaactgggcgagctgctagtgttttaccgaaaaagttttctgtcattaagcttctccaatcaaacggagcaagtattgtccgtattcatttttcttaagcggttgtgccaatttatacacttgttcttttgtaatgtagcccatgcggtaagcaatttcttccaaattagccacttgaacgttttgcaaacgttgaaccgtttcgatgtactgtgcagcttccaagaggctttcatgcgtacctgtatccaaccaagcaaatccacggcccataagctcaacagacaagtcgccgcgttctaagtaagccttgttgacatctgtgatttccaactcgccacgaggtgaaggcttgatatttttcgcaatctccacaacatcattgtcatagaaataaagaccagtaacagcaaaattcgattttggctcttcaggtttttcttcgatagagatggcattcatatcagcgtcaaactcaacaacaccaaaccgttctggatcttttacttgataaccaaagacagtcgctcccttttctttgctagcagcacgttgcaacatcttggtcaaaccatttccgtggtagatgttatcaccaagaatcaaggctacattgtcatcaccgataaattcttcaccgataataaaggcttgcgccaaaccatctggacttggttgttctgcatatgaaagtgaaattccaagttcagaaccatctcctaacatatccttaaaacgtggaagatcttgcggagttgaaataatcaaaatatctttgattccagccaacatcaatgttgacaatggataataaatcattggtttgtcatagataggcatcaattgttttgaagccgcacgtgtcagaggataaaggcgcgtacctgaaccacctgctagaataatacctttcatataagagtaccttccctaaattaatatcagttcattataccatatttttaaagatattgtcataagaaaaaagcctgtgacgacagactttaacaaattatcctagagcaacatctaaaatcatcatgatgataaaaccagccattaagcccagagttgcaatatccgtattgccgtttgtctgcgattctggaatgagctcttctacgacgacaaaaatcatggcccctgccgcaaaggagagggcataaggtaaaataggtgtcataaaagtgaccgcaaaagcaccgatgactgctgcaatcggctcgacaattgctgacattgatccccagtaaaaagctttccacctagatgcgccgtctgtacgaattggaatagccaaggctgccccttcaggaatattttgtataccaatcccaatagcaagaccaattgctccgataaaagctgctggactatagttagaagcaagtgcaccaaatatcacaccgaccgccaaaccttcaggaatattgtgaattgtaatagctaagaagagcagggctgttttggatagattttttctatccttctcaccaccaccttctgccttatctttatcatttcccaaatgcaaatgcggaacccaggcatctaccaagcgtaaaaaaataccacctgctgcaaaacctactgctgctggtatccaagccagattgccgtatgaactttcagcatactcaatcgatggggctaataaagaccaaaaagaagccgcaatcataacaccagctgcaaagcctaacatggtgtctagcaaacgacgactaactgtcttaaagaaaaatacaacggcagaccccacaatcgtacaaaaccatgtgaataaaccacctagcaaagcctgtagaactacagactgattagtaacccaagtcataactaacatcctatcctgtttaatcttgcatatcctataaagtaagataccctaatttattataaaattcaagctttttcacttaaataaataagaaaatatctaaaaaataaaagacctaaaactacattaaatgtcgtcttggtctttccacaatcaagtgctgattaatttatcacaaatgtctaaacggattggttgaaacagttgaaggtagaatttcgacatcccaaccttcttttgccttccatatttccaacaattcagcaatttttttgataaataatacttcgatatgatggcctggatcaatagccagcaagccctgagtcagcatgtcctgcccagtatggtagtaaatatcgcccgtgatgtaaacatctgcccccttagcaagagcctcatggtagtaagacccaccactgcctccacagatggctacacggctgacatactgcttggcttggtgcccataggtcactagacggacagcatctagatcaaagacagacttgactttcaaagccaattcttccaaagtctgctctgctattgtccccacacggccaagcccctgcccctcggcagtttcaatcaagtaggtagtatcttgaatttctagtagttcacagaaccagtcgttgagaccaccctcaaccacatcaatatctgtatgactaacatagactgcaatatcatgcttaatcaaatcaagatacattttagtttgcggattgtcagccaccaaatcatttattggacgaaaaatcggagcgtgcttgactataatcaaatctacctttttatcaatcgcctctgccactgttgtctcacgaatatccagagccaccatgacacgttgaatctctttattaagggtaccgatttgcagccctttgacatcgccttccatagccaaagaatggggacaaaaggcttgatagcgctcaataacctgactagctaacatggactacctcctgaatttgttggatcttttgggaaatggcaaagcggtcaccttggcgttcagatggaacttgttccaaagcaaaacttaatttttcaagttctcttctccactttttgacgaaaactggcgaggtctcctctagtagatagggaccaaaacgacgttcaacttctgacaatctcatctgtcctgattctgcaacgaggacttcatataacttgccattttcttccagaatcttttcagcaaccaatctaaaaccatttttttccaaccatcgacgcacatcatcttcacgattatttggctggagtatcaaacgttcaatggtcgcaagcttttcttttcctgcttctaagatttccgcaatcaagcgtccccccatacctgctatggtcacggcagtcatctggtcagacttctcaaacgcgcctaagccatttgccaaacggactagaattttctctgtttgtcccgcctgctctacattctggagcgctgactgatagggaccttgaacgacttcccccgcaatggcaaaatcaatacgcccctgctctaccaaaaaaagagggagataagcatggtcactccctacatcaactagacgtgccccttgtgggacaaaacttgcgactgtttccagccttttagataattttgtttccatatcaatctttccagagatccattgcatcaagaaagtcacttgaaacagtcacattcttaggagtctggatttctctttctgcatttttcgcttctacttgcacaactgtagtaattccctcacggcgccagtttcgtagaatagcttggatgtatttccaatttgttttgttgttaaaaacagcttctttcaaggctgcacgaaccaaatcaatcgaagttttgtcatcctcaatagtcttctgcaaatcttcaatttcaaacggcgataaaaagcggcccaattcacgttcaaaatcacccaccaaggtcttcaaatcattctctggttgcacaatctcaactgcctgttttggagttaacagaacatccaatttttcaaaagcaggaagcgcatcgaatatcatttcaatttcaccagcaatactgattgtcttaaattctaagagtccagcatcttggagattttcaatagcttgattgacctgagcaactgttttaccagtagcttgagcaatctcactaggcgctaatgattcgatagctgaagaattttgatataagaaaaactgccaaatcaaaaaatcatctgccgacggaaaaagctcttgatagtggaataatattgctgctggcaggaccaaatgtccctgacgaaattgctgtgaatagttcatacttcctctttaaagactagctgactgggctgattgttcaaagatatgccagtcgtatggagtttcttgatagacagcataattcacccagttggtaaagaattgtgctgctggtaaattccaagagagagatggtttgcttgtagggtcatctcctttgaaataattttccggtaaatggggattttttccagctatacaatcacgttggtattccttagctagtgtatccctatcatactctaaatgtccaaaactataaattcctcttaaatccttgctggctagaatggataggccaacttctggaccttgtgataaaatcgtcaacccactcagatgggcaatatctgcttctcttacttccgtataacgggaatgtggtgaacgaaattcatcgtcaaatccacgcataagagggctcgttggattagtcacttcttgacaatatacccctgatagttttcgagacatactgtgtttgggtacaccatagcgtgcatacaaacctgcctgtgcaccccaacaaatgtgcaatgttgaataaacatgtgtttttgaccaatcaaaaacttgagtaagttcatgccagtaatcaacttcctcaaaaggtaaattttcaactggtgctcctgtcacgatgagcccatcaaaatagctatccctgacctgctcaaaagtcttataaaactgcttcaaatggcccgagtgtgtatttttggactcgtgactagccatgtagagaaattcaacctctagctgtaaaggagtgttagccaaaagacggagcaactgagtctccgtcactatcttctgtggcatgagattgagaataaggattttgataggacgaatgtcctgatgactggctcggtcactatccatcacaaaaatattctcttttctcaaaatttcaactgctggtaatgatttttcaattttaattggcataagcaacctcccaattttcttatatttattataagacaggttgctatgcaattcaattagaataaaaataggaccagttataagttttggctataaccttagattaatagtgcatcaaaaccttgtagtcgtaatcaccgattgcttcgcggcctttcaaatcatctagctcaatcaagaaggcacagccagcaacgataccgccaagcttttcaatcatttcgatcgttgcttttacagtaccaccagtcgccaacaagtcatcgacaatcaagacacgttgtcctggtttgattgcgtctgcatgcatcgtcaatgtatctacaccatattctttttcataatcagctgagataacctcacgtggtaacttacctggcttacgaactggtgcaaaaccgattcccaattcaaaggcaactggacatccaacgatgaaaccacgcgcctccggcccaacaatcatatcgatttgcttatctgtcgcatactgaacgatttcacgtactgcatagctataagcatttccatctgccatcaaagggctaatgtcacggaattcgataccttcttttggatagttaggaattgttgcgatgtaatcttttaagttcatttgtctctctctttttaaaaataatttttactcttcattataccatgaaattgttttttggtacatttcagacatatatctttagcaaatcgtctcctcaaattcgccacacaagctgctctactatgtccaccataggaaaagcttccttgctgattaaagtaagactgctcccagccaacctcatttcttcctttttggtagcgacgaaagcgagtaggagataaatagactcccatctttgagcgtagcaattctttccgaaaaatgggatcctgcctgccaactggagaggcagggcaaaaagctcagcgccacttcttagagttcgtgtcaacatctcagtgcagtggttgattggcggatttgttcgtgttttacactccaaatccaacctaatcaactgtgcgggggtgggaagacgaactctttttagaccagtcgagttctttcccactcccgcttattattagctctggcataattaaaggaagccccatttaccacgccattgacatgcggtcgttcttctaaaatcaaggcaaattgtccatcttgatttaggataaattcgctgtgaaaatgaatcaaaatcttcatattgactggcaaggtcttctgatttttcttgccgaacagttgtttattgtgtaggcgggcagattctcgtaagcgataagaccaccgaggtaggctacgtacataggctatcagagcctgccaatctgtttttccttttccaaactgctgacgcacccaaaaagtctgctgataggaaataaggtagcgtagctgatggacctgtctgtttaacggccgtttgacttctaattcccgaactggaaaagccttatcaactagcttagcaaagtaccgccaaaacggatggtgtggaggacaattcacatccatcttctgcaaaagttcaggtaatatcccatgacttaattcctcaggaaaatctaacatattcatacattgctccaataaggccgtcgctttctcttggcttaaagagcgactgtcaactcttatcaactgataaaagctagttgaggcaaaaatagtagcttcttttatgaaattttgaacaaatgctgggatgtcttcttgttttagaggcaacagttgtttcagaaaaacctttttgatggctctttctgaccatcctactcgccgtaattcaatcagtgcgtgctttatttcggttatctgttcaagatttttcaacaaacctttttgcctgataaaccaataagtgtagagaagcgttccaatcactccaacaaccagagcttctactgtcatcaaacgcgaccacatagccattcataaatttcctgaacggtgccaagcgccatcaactcttgttggataactgtttctttcaattcttgatatatttgactttctgaaatctctcgcttctgtgcctctttgttgacccgcatgaccccatccgcaatcgtgacaaattctaattcttggaaaatctgaatcattttaaccaatagactgtccttaatttttaagtaaacagccaaatctttcagtttatagcgaacatcaaactcttcaaattggtaaatagtcttatacaatttagcgaattgttctcggctaccataaccatctagatagtacggtttggcaatttcgtttttaaaataaatggcttcaaattctctttcctgaaaatagctacgcagactactgaggtcctcaggcaagttagccaagacaattgctttgttatctgctactggattttcaatgtccaaaattgggacccctgcaggaataggatgttgttttccacgaatattataaagttgaacaccattgacccgagcatcaaccaacatgagctgaagactggtattgccattccattgattgacagacaaggtgacagctagttctaagcccttggcctgtgaaaattccaaggctagattgcccttaccaaaagcaagaacatcaaatccagcagcacctttagtaatgcgtagtttcaaatgggcattattctgccccatggttcttgctgattccacctgaaagtctctgatgtaaaatacaggctttttattatccatgccgtaaggcgcaagcttctcgaaagattttagagtatctagggttaattcctctaaatccaattcttcatctaagaccagcgaagacttgctggataaatccaatttattttcgataatgtagtctgtcaaggtcagagcaagctcttcaagtttgtcaacttccaaggtcatacctgctgcaccagcatgaccaccaaaggcgataaataggtcctgatgatctttaagtgccttgaaaatgtcaactgcttcaacagaacgagccgaaccctttgccttaccatcttcaatagacaagacgataacaggttgctgcagttcttctagtaggcgtcctgctacaatccctaaaacacctgggttccaaccttctttagccagaacttgaacaggtctatcatgacggagcatggtttttgcttcatcgtaaattgcttggacgacgtctttacgttctacatttttactgtcaatcatgagggcaatttgatgggcctcttcgtcatcaaaaccagtcagtaattcgatggctggatttggatcatcgagtcgaccaagggcattcaacctcggagcaagttggaaaccaactgtttcttcatcaatactgtctatgtcaataccagctatctttatcaactcttgcaaacctgctcgctcagtctgtttgagaagcgagagaccatatttgaccatgacacgattctcatcggtcaagctaaccatatcagcgatggtgccaattgcgaccaaatccagcaagtctgcatgaacagtttcaagaagagcacaggccaatttaaaagccacgccgcagcccgccaaatgtttgaagggataatttccttctggatgctctggatgtacaatcgcataggcattgggaagggtttcttgcatggaatggtggtctgtcacgacaacatcgacacccatttcctgggcataggcaatcgcttcatgacccgctacgccattgtccaccgtcacaataagagaaatcccctgttgctcgataaaatacttgtaaactgactgattcggcccatagccatctgtaaaacggttgggaagataaacttggacttctgcccccatttcctccagagtttctttcagaatagatgccgaggtcataccgtctgcgtcataatctccataaatcaaaatgtgttcgtaattttcgattgctcggcgaatccgctctaccgccttgtccatatcatgtagtaaatagggatcgtgaaggtcttctaagcttggttgtaagaaagtatgcaattcttccgccgaatggatgccacgttcatacagcaacttagccgctaccgggtccactccttcttttttagcaattttgataaattgttcatcagaaaaaccggtcaataattgccagtcataattgggctttatcacgttttttactccttaatactcaaaatcacaagtagcctgtaaattttccgagtataaactatctttctattatatcattttccaagaaaaatggagcaaggtaagaccgaaacagaatgtcgatcccttgctccatgaagaacgaatattacaatttataataacggcgaaataattcgcagtagggctcctcccaaacgcttataccaagagtacgttttatggaaggttagaaggttaatttgctgtgattttttgaaggaatgagtaaagtcatccttaatagctgccaaaacttccgagtgattgtaaatatagagaccgcattcaaaattaagataaaaagagcgaaaatccatattcaccgtaccaacagtagctttcttatcatcgaccaaaacaactttggaatggacaaatccaggctggaattcaaagatttcaattcctgcttccaagtaagtcggaaaatcagtacgagcagccaaataggcagattttttatcgtagatatgcggtagcagaatgcgaacctcgactccacgcttcgcagcataagtcaaattatcaatcatttcatcatccaacactaggtagggtgtcatgatataaatataatccgttgccgactgaatcatgtctaggcagactcgtttggctacctcatctccatcaaatggattctcgccatacggaaggaagaaaccttcggcatcaacggtttccgtctctaaatctttatgcgttttgaggtattttaggtcatctgtctctgtcttttcattgtaattccacatttgaaggaacatcaacgtaaagtttgcaacagcttctcccctaatcataatcgctgcgtctttccagtaaccaaaacgcactttcttgttgatgtattcatctgcgatattaatgccgccggtaaaggcaacctttccatcaataatcgcaatttttctatggtcacggttattttgcaccgtagataaggctgggataatttgagaaaatactttggcttttattccatattttctcaaggttttatagtaattatagggaagattggtcagtgaattcatcccatcatacataaaacgaacttccaccccttgcgctgccttttccttcaaaatgtcaaggatagaatcccacatatatcccatatcaacaataaagtactccatgaaaatatactgctctgcctttttcaattcttctagtagagcttcaaatttttcctgacctgttgaaaaatagacggcatccgtattggtatgaattgggtagccaacgtactcactcatgaagtgagctaatttcagttgctccttatcttcctgctccaacgccttcatgaccttttcagacgtcttactatactcccgaagtctttgtgcttgcttatgaaaatttttacgataacgtttggtttcaatgttggactgcaaaataaaatagaatagggcaccaaaaatcggaataccaatgacaaaaataatccaggttaacttaaaactggtattcatcggtctattgatgattgaaatagctacaaaaatcgaaaaaatttgcaaaacaatcaataaagcaggcatataggttgctgccgaacctaccaaccaaagaataaggaaaatggttagaataatcaaactaatgacaataaatgtccgactatatataattttccaaagtttttccatacatctctcccttagttttttaccattataacagattttagttcattatcctactcaaaataaatagtctctatgattcgatatttctgaatattttaaatatataaacatattcaatttatattgtaaagacatatattttttgataagataggcatgaaataacccgttttaatttattaccccgtacacattatcaaaaggaggaagttcgcatgaaactttcatataagaaaaggctgttgaatcaagtcctacttgcctcaacagttcttttagctgcatctctcgctcagggaacggtcttcgcaaatacagaggagataccacctactactagtgaaacagtgactccactgcctgaagagactcctattacgaaaactagcacaagcgaagctacagataatcttgtagaagggaaggagacagaaaaacaaactgaagaaatagcagatacttctcccacacctgtttccacagaagaagatacaacatcttccgagcccaatgccgaggaaactacgctcagaacagctaataatgataatcaggatactacagaagaaaaatctgccgtaccgactattgatacagttacactcgaaacaaaaactgtctatctatcggaagcagtcactatcacagaatccatcacacttccagatacgactgaaaaaatagaatggacattggatggaaagtctatttccgaatggaaaacctggaatttgaaagagggagatttcacaggagatacttttatcacagtagaagaaagcagacaggataaccaacttcatttgaatatccagctcgcagctctctttggagaagatttgagtaaacggacaccgagtaatattcgccgtacctatcgacattttataaaaaatatgctgttggaaggtactagtgccgatggaaacttgataatttcaaaaactcttcatttccgtccttatgaagcctaccgtacacatgaggaaatgttgacagagattgaggaaacgaaaaataatgctgcgaccgaccgcctagtaaggattgagtcaattggtcaatcagctgaaggtagagacattaaaatggctgttgtggctaaagatcaagcaagtattgataaatatcttactgagacaacaccactcatgctgacccaacccgaccagatgctgaaacagttgcaagctggaaccttcgactataaattacctattctcatcaacaacactcatgctgacgaacaacccggcatagatgtggtaactagcctattcaaagaatttgcacaaaaagataccatcacctttccatctacagatgccgatggaaatcctgttactcttcatttaaaagtgacagatttgttagataaatttatcttcttgttcaatttcacagaaaatcctgatggcgatgttaaaaacttgcgttcactagtaaatggtttggaccctaaccgtgatactggtttccaagtgaatccagaaacacaagccatcgttcgtcaaatccacaaatggaatccaatatctgttttagatattcatggttttgtatctggatttctcatcgagcctgccactccgccacatgacccgaactttgaatatgatttactagccgatattatgctggaaaaagctcatgaaatgggccgagcaggtattgcaaattctaaatatgaacgctacaccatccctaaagtccactggggagatggttgggacgattccttctcaggctatacagcggtgtatgcaatgtaccacggtattcttggacacacgattgaaattccagaaggaaatcaagaatcattcaaggcgggattctttgctgttttgggcggtgttcacaatatggcaaccaaaccagacagtcttatggaaatgcgcctcaaatactattcacgcggtgtcaataaggtagaagatccaaaagcagagtctgaactagtcggaccagacggagctgttgtcggacgtgtcaaaaaagaccagccaaaattcttcccagactactatgtgattcctatgacgctcgataaacacaacgatatgcaagaagcatttaagatgattgaatatttcaatcgtaatggggttgttgtcaaggaattaactgaagatgttggaaacttccgcaagggcgacctagttgtcgatatggctcaagccaaacgaggattcgctaaccatgtcctctacgctggttctgatgaatctgcttggggagccatgtatgctgaattggtggtcaacttcccagatatgaaaggctttagcgccaaggctgtatttgaagaaaacacctttagcggcaaattaggtagcatcacatggacaaaagctccacgtactacggaaattgatttcaaagcgccttattatgtcgttgcaaacacctctgaaagcgccgttcaggccattaatcaagccatcaaatcaggcgctaaggtctaccttacagacgatggctacatcatggaaactaaccaatttagtcacttactggacacctatgctctatacggcgagcctctctataagaagcctcttggacaagaattgaaagcaatgaaggtgtacgctccttctcactcttatagttgggcaggcgactttgccattcttgcaaatgctgcacttgcggtagaacgaatgggctttgaaattgtcaatagcgcagatgaggctgatgctatcattctcgaatcagaccaattcgatgccagtgtatttggtaagaaaccaattatcatcgtaggtggtgtcgccatgcaaaaactggaggaattaggaatcttagcaggtttcaatgcggaacaatttacagatggtggtgactatgaaggtctcatgcgggctattattgatgataaagatccattaacaagtggctacgccatgaatggacttttctattccaactccggtaattggattgaaggcattcctgaaggatttaaaacgcttgttaaaatcgctgataaagattattatatcgcaggttggtggcctggtcatgacaaattagccaataaaattgtcgccatcgctggaaattatcaagaccaacctgtctttatctatgcaggtaatccaacaaacaaggtccaccctgttcacttcttccgttgggtgtccaacgccctatttggtagtcaattagcaagcttagaagacttaccagctgtagaaattcttgtaccacaacctgaaatgccaaaaaatattctggatgaggcgccaaaaactactacagtagtacataccaccaagtctaccgaggcaaaacaactacctcaaacaggtgaaaaaacaaactatatagctatcgcattaggtagcctacttctaggcagtatcgccttacgtagaaaagagcgtagctagtctacacgaaaacgccgagttttatttcggcgtttttctatgcttattttaaattaaatactgtactggccaagtagtctgctattcttggaaagagagtatagagtttatgagcagctgctagtgaccaaggcagattgatgtctcgtttcttcgtccccatagctgaaacaatcttcttggcaacatagtctggttgcagcaagaaagccttgacgctctcttgatagcttccatccgggtcagcctgatcgaaaaagctggttgcgattggacctggattgaccgttgtaactgtcacaccatactgggctaattccaagcgaatggtattagaaaaacccatggccgcaaacttggtcgctgaatagaccgaggacttagctgaagcaatcaagcctgacatggaaatgatattgataatctgcccgctccgtcttgccttcattcgtttacctactaaacggcacatggtcatcagagcaaaagtattgatatcaaacatggcctgcacctgctggctggaaaaattctcaaaatcatcgtaaatggcatagcctgcattattgactagaatatcaatctgaccaaactgactatccagttcatcaaaaaatgccgtcagagctatttcgtctcggatgtctacatcaaagacagcctttttttcatggtaagcatagagctgctcaatttttgccacatcacgacctagtaaaatcaaaaaatcatctttcagcaatggcaccatttcctgtaccaaaccaccagaggcacctgtgattagaatggttctcatagctcaatttcctctaaatctttgacaatatgaacctgctcgaaaatagtacttgcatctttccgtaattgactaatatccttggataaaaatcgtggactgatatgattaagcaagagctgcttgacacctgcatccttggcaacctgagcggcttccatattggtcgaatgcccgtgcttgcgagcaatcttctcatcgccttttccgtaagtcgcctcatgcaccagcacatcagcattaacagccaagcgtacactggcatggcacttgcgcgtatcaccaagaatggtcactaccttaccaggccgaggaggagaaatatagtcactcgcgataatttcagtcccatcttctagcgtcacgttttgaccatttttgattttaccgaataggggaccaaatggtacacctgccgcgcgcagagcctctgcatccaatgtcccttccaaatctttctggatgacacgatagccgacacaaggaatggtatggtccagcttttcagcgaataccgtgaatttgtctgtttctaggacctgacctaccgtatcaacatcaaactcatgaaaatgaatgcgataaggtaggcgtgtccctgatactttaagacttgccaagacaaaagaacggataccaacaggtccataaatatcaatatctgtctgctcctcgctagactggaaagaacggctagacaggaaaccaggcaagccaaaaatatggtcaccgtgcaggtgggtaataaagattttagccaccttgcgtggacgaatggtcgtttccaaaatccgattctgagtgccctcaccgcagtcaaagagccaaacctgattgatttcatccaagagtttcaaggccaaactggatacatttcgagccttggagggctgaccagcccccgtacctaaaaattgaatttgcattgtttactttctaatgttttatatataaaattgcagagcgacccgaccagacatagtaatgctgaccagcatagccgtccgccacttccagcacttcttcctgattaaagcctgaaatcttgaccaagccttctccggttgccacctgggttaaaaggtagtctgtttcaacctcctctaactcggcgtcctcaaagggattgactttcataaaaatcttgccctcctccacaaagacgacatagtggggaaagacttgggcgatttcaaagagcaagctatccgtcacttcctctcctacttccgaaaaaacctgggccagaccgtccgccgacacataggtaaatccgaaagacttaccagataaattcaggcggacaaagggcttgctttcagcaaagctgggttcttttggaaaaaggcagagctgctgagaaagagtgagatagtagtccgtcgcctcttctgccccttgtttctggtagatttccgcaaaataggcattgataaccgaaggcggtggcgtgataaaatctagtttttgttggtcagtcatatcagccaatttcctagccagatagaccttgtccaggctggtaaaaccaccgtatttgattgccaaatcaagataatccgtcataaaattcttccaacttccatttattgctggaagcgatatagcctgataccacttccacatcctcttcgtaggtccgattttcaatcagagccagagtagctaaatcatgcaatttataagattcagcaagtggcaccctgacctcaaatcgttcaaacatggtctttatcttggccaagaccatcatctgaatatggcctttggcattttcatccttagtggacagcatgacatgaggaaactgactgggggtaaagctgtcatcggtcttgtccagcttgttgtagagagctagacgtggaatgtccagcatatccaggtcttttagaatgtccaagaccacctgctcctgctcactgtgattggggtcagaggcgtcgatgatatggagcaagagatccacgttcatggactcctccaaggtggacttgaaggcagaaatcaactcagtcggcaggtcctgaatgaaaccaaccgtatcggtcaaggtcacattaaatttgtctgccaagttaatctgcttggttgtggcatctagtgtggcaaaaagttcatcagcctcgtactgtcgcttgtccgtcatggcattcataatagtggacttacccgcgttggtatagccaatcaagccgattttgaacacgcctgattgcaaacggcgttcacggacagtcgctcggttcttctccactgttttgagttggcgctcaatgtcatgaatctggttgcgaatgcttcgacggttgagctccaactggctttcacctggtccacgagagccgataccacctgcctgacggctgagcatgatgccctgtccaaccaagcgtggcaacatgtacttgagctgggctaggtggacctgcagttttccttcgtgactccgtgcccgcatggcaaaaatatccaaaatcagctgcatacggtcgatgaccttgacacctaaaatctcttccagattgacattctggcggggtgttaatcgattgttgacgatgacagtatcaatctcgtcagcttcgaccatctgggcaatttcgtccagcttaccagaaccgacaaaagtcttgctgtcatatttctcccgcttctgcgtatatactcctttgacgagggccccagcggtcttagccaggcttgccaactcttccatggacacgtcaaaattatctgtctgctgcaattcaactccgaccaggagggcacgttcttgttctttctgggtttcaatcatctaaaaattcctccacagcggtgtaaatcctatccttaacagcttcttctgatacttggtaaaaatcgactgccatgcggtttctaaaccaggttaattggcgtttggcaaagcggcggctattttgtttgacattatcaattgcttcttctaggctgatttgaccttctaagtaggggaaaaactccttgtagccaattcccatagcagcttgagcttctgggtgttcttggtagagccagctaacttcatccagtaagcccgccgccatcatcttatccactcgctgattgatgcggtcgtaaagaacctgtctgtcatccgtcaggcagatgtaaagaggctcatatcctgactctgtattttctaagttttcgccaaattttttcaattccagtccacgaatgattctccgtcggctgtttccctcgaccatcaaacctgcctgctctgccattgtttccaaatcctcgtcagacaagcagtcgagttccgcccgataagcaagtacctgctcctggtcaaccagcccgcccagatggtagccttcaagcaagctctgaatgtaaagccctgtcccacccacgataataggcaacttgccacgacttttaatgtcagcaatcagagccttggcttctgctacaaattcataagccgaatagccctcggtcacatctcggacatcaatcaagtgatgaaccgcagcagcctgctcttcaggactagcttttgccgtaccaatatccagtttgcgatagacttgctggctatcaccgctgataatttctccattgtagcgctgggccaagtctatgccaagggcagtttttcctaccgctgtcggtcctatgaccacaataactttagttttcatctttttccttgaaaatattttgttttttcgctaaaatctattataacacaagtaaaggagaaataactatggctaaaggttttggtaaaggtttcttgacaggtgttctttctacagttgctcttgcagcaggcgcagtcttcactgttcacaaaacaatcattgaaccagaagaaaagaaagaagctttcattgaggaaaatcgtaaaaaagctgctcgtaaacgtgtggcacattaaaaagctggcaaatgtccagctttttttgtttgacaaaaaatcccttagaagctctgccattttcacagaaaaatgccagccttcttaagggattatactttataagataatatcttctctttcaatgagaacaatagtccacatcatggcaagtgtgacgatagccagagcaagaatcaatggcatccagtttccgaagattggatagctgtaaccgagaaggcctggtccaaatgctgcaatgagatagccacctgtctgcaccattcctgataactgggcagtagcctggctgttgcttgttttcaaagtaaagctcaacatcatataagggaagagggctgcatttgaaaaacttaaaataatgtgaagtgctgaccaaagaatgagattggtcggaatcaatgacatcatgaacaaaccaagtaaggtaacagatgaaatagccagcatgatatttcgacgcatttcttttgtctgacgagaaagaacagctgggataatcatagacatgggaatagctgtcatattgaagaaaccagccattagccctgcttctgccttactaaagccaactgattgagaaatagttggcaaccaggtaatctctgtatagtagaggactgattgtagcccaccaaatatcaaaaaggcaatcgctgctttatttttccagatagatgatttctggtttccttggttctcacttgcaaatcgatggttattttttacattaggcaaccagatcaggaaagccataaacaccaatcctgtaattaatagaataaaaaattcccaagaactagaggatacaattggaacagcaatcatagatgcaactgttgccgccacccccatgagagtgatataaatcgtcgtatacagaccaattttctttggaaaattagccgcaaccaaacttggtagcaaaacattaataaatgctattgtagcaccaacaagcattgtaccaatgtaaagggctggtaagttgagaactcgcattcctgaacccagcaccataaccagtaagactagggccattagtttttccatgccaaacttagccgcaagacgcggtgctaaggatgaacagagagcaaacatgatgagcggaatagaggttaaaattcctaatgaactcacttctactctcagtcctgctgccacatctatcaaaatagcaggcaaagctgtaaagggggcacgcatcacgacccctagcatgacgattcctgcaattataaatggtgattgttttttcatttttctcctaagtctcctaatgttcggatttcagcacttttgattataccatagttgacaaatgatagaaagttatttccttctattttttcaagttatagtttttaactatggatttgccatgaaaataactatttttcaaatgatagcttatgagttagaataggttcatcactaaaacgaaagagagacacacatatgacaacttcaagattccaattagtcggttcacttcttcgaccagcaaacttaggagaatttaaacgacaaatcgaagctcgtgaagacatcaaatacccattctatgatgacttcgatggttacaaagaaactgaagcttcactcatccaaaaaattgttgcagaacaaaaagaaaacggtttggatattgtgacagatggagaatttggtcgttcaatgtggcacctagattttctctggggcttcgacggtatcgagcgttacattgctgagcatggttatccatttaaagaccatgatggacagatttttgaaacacgtaaggatattggattgcgtattactgctccactttctgcaaaaaatcaccatttcattgatattttcaaacaagtgaaagaattagcaggagaaactgtaaccaaacaaactattttcggtccagcccatgcctttaatgaattgacaattttcaatggacaagttggaccaaatcaggtctacaagactcgtgatgaattaaaagtcgggctcatcgctgcctataaggaatttttagaccagtacaaggaagctggtggacaaatcgttcaatttgatgactgcctttgggaattatttgaccctgctaaccctgtacctttcttgccacaagacgattctgaagcattggccgctttggctgacgagtttgttgctatcaataatgctgttattgattacggacatgaaattggcttgaccgtctggacgcacaactgccgtggtaactatgaaagccgctctgcagctggcggaacttacgaagctattgccgaaaaattcctgcgtgaccaaaaatacgatcgattcttccttgagtgggatgatgaacgtgcaggtgatttaaaagctttggaaagcttgcgtgacaagaatgtcgaagtcgttcttggtctactttcaagtaaaacttctgatttggatgatgaagaacgtgtttacaaattactcgaggaagcaagcaagattattccaaaagagcgtctctacttgtcacatcaatgtggattcgcttcatgtgattcaggtaatgaattggccatcccgcaacagtgggcaaaaattaaacaaggccaagaaattgcagagaagttttggtcttaagccacttcttgttattcgtgcataaaagccctgtcatcaatcagtgtctctaagttaactctgatcagttaatctatgatatctaatcccaagtatttttccgatgtaatacttgggattttatgttcggacaacacaaagggaggcttttttatatagtctacaggtttatcacaattggccacgagggtttcatacttatcggtgccgaacatgcgaaaagaaagggagtaaaactcggtttcatgctgcttttcccatctcgaatccgaatcagatagaaccagcctttttattggtaacaatccataaagttataggttttatgatctctatccgctataatgagggctggttcgaaaatgtcgttaagatttaatctctaatccaacttgaagtactagcaatattttaatagatttatatgataccgttgacaaagcaacgttgtgacaatgctttaagggagtcgggcaataggattggtataacttgtgacaaatagttgatatttgctgtacgatgtgattttacgatatgctgtaagtcgcttatttggactaagttcctgtttgtttcatcgcttacagtatcgtccatttgggctttttattgtatattaaatgtaactagcatcacaattcttttatatatcagccaatgaaacaactactcttcgccattgtatttccgactaggctccccaatcgtttcaaaacttgctcgaccatccgcagccagagcctcctgctcataggcattgataatctgggcaacaactgggtgacgaaccacatccttggctgaaaaatgtacaaaatcaatctgcggaattttgcttagtttctctgtcgcatcaatcaggcctgacttaaccttgcgtggcaggtcaatctgactaatatccccattgacaatcatcttggaattaaagcccagacgggtcaggaacatcttcatctgcataatggtcgtattttgcgcctcatccaagatgacaaaggcatcttccaaggtccgaccccgcatataggccagcggtgcaatctcgataatctcgcgctccattaggcgcgtggtctgctccttgcccaaaatctggtagagggcatcatagacaggacgcaaataagggtctactttttcttttaagtcccctggtaaaaagcctaaactttcacctgcttctaccgcaggacgggtcaggacaatccgcttgacctgtccccgcttgagggctgttacagctagagtaaccgccaagaaggtctttcctgtaccagctggtccaattccaaacacgatatcatgacgctttacgctgtccacatagagtttttgtccaagggtctttacgcgaatgggtttgccatagttgtccttgataatctcttcttcatagagggcaacgaatttctcaatctcatcattttttgccatggaaatagctgtgaccacatctggcgtattgataactaaaccacgactcaccaagacaaggagagactggataacaagacgcgcctgttctacatgttcttcctgtccaatcacctgcactttttccgtacgggcatgaataaccacacctagttcctgttccatcaatctcagatggcgttcattcgaaccaaataggctaaatgaatcatctggatgcttgagttgaatatcaattgaatgttctagcaagagttgctccttttcctgtgcttttctctattataacaaaaatagcccaaacaaggctattttgtactattttatccatcaatgtcccaaataatcttcccaaatcgcatcaaaatcagacatggaaaaggcaaagctggccgattcctccaaaaaacgactgacttcatcgaaattatctgattgcttaggaaaatcagattcatcaaaggcataatctgccaagatagctactggttcattacttttcgggttgcgctgggtcatcaaccaagaataaaaacttcttctcactacatctactttctatgatttttttcgtagagctctatatagcgctccatagacatcttactaaccaattccccaatcaattcataaggaatattcttgggatttttcatacgaacacaggacttgcccatatccagtttggtaggcacctgtgcttgataagcagcaacgaaccaatcattcaattcttggtccatatagattcccatgtggtagagggcgatgtgtgccttttgtgatgccaaagcaaggaatggcaagggctctcccggtgtgcaatgataaccatcggggtaggcagcaagcggcacataatagttaatcatacctcccaagattcctacttcaaaaccagctggtaactgttccacaatcacttgatggagccgttcaactacttccttccgattttcaggcaaggcagccaaatattcttcaatcgtttccacttcaatcagcatgactttctcctatctcaaccccaacatactttccttggcatgaatcatatctgttatcatctgacagtatggcgtagagatacctgcacgtttgcccttaaaaacaaccgctccattcagataatcaatttctgtctttcgaccatgttggaccaaatcctggtgcatagatggatagtgattggaagccttcttcgaagcatcaataacatatttccaaatagcttcttcgtcaattccatctgcctcagacttagcaacagcaataaattctttgaaaatcccctgtactagatttagtccagcctccgtaccaaataattcaccaattgtacagtctaaaatggtacaagttggattcatcacaccattgacacaggctttctgccaaatagcactgacaacatgattgtcataggtcacatttagtccagcttcattcagcatttcaataatatccgcaactgattgctcatcaccaagaatatgctgaacggacatagaacccggaccttctaagtgagcatgtccaggaccctttagtcccgccaaccacatggtcaccccaaccataatactttcatctggcacgtaccgacgcatggtcgtcgcatgccccaaaccattcaagagactcaaaaccttggtagttggaccgataatcggtttaatatcccgcaacatctttggcaactgatcagcctttgtcagtagaataataaaatctgcttctctcgttgcttcggtcggtttcatgatgggtaagtatacagtttcctctacgtctccagtcactttcaagccgttttctcgaatcgcttcgatatgttcttcccaattatccagcaaaatcacttcatgatttgtcttagacaattgataaccaaaccgacaccccattgccccactaccagcaatatatactagcatagacgccccctagaccaactctgttccaaaagaatcctgtttaattttcccagccttcatcaaaccaccaagagcttttttgaattgccctttggaaataccaaaggtggccttgatgtcttccggagcagacttatcgttcaaggtcatgaaacctccattgctttccagataagtcaatatcatctgagcatcattttccagcatctcaaatgaacgtggcttgagagacaagttcaaggtccgatcaactgcacggtagccgatgacacgagcctccaaaacctgacccagacgtggttccgcaaatcgttcacttgggtggataaaaccaagcatgttgttgtctggcaaataaacaaaagtaccattcattttcaaacgatagacaatcgctcgcagattttggttttgcatattatcataagcaggtccagccattttctgaaaatcttcttgaaaagctggcagagcccaaatgcggtccttcttatcgacgtctaatttgacgtacaaccgatccccttttttcggccagagttccttgatttcaggcaaaatgtccaaggaaacaaccacttgcttgtctggtagacctgtatccacaaagacacccaaatccttacgtacctctgtgacagttccccaaccaaagctggtacgactcgccccaacttccttagttgtcaaacggagtttttgtttcatatcggtataggcaaatcctttaacagattgacctagactatgttcgccttcatccttagaaagagcaaaggttctaccctctttttggacaaagtaaaactgatcgttttcgtcagtcactaaaccaacgatatactgtgctaataaatcattcatgattttcttctttctgattaaaaagtgggggaagtcttgtctaactccccccattagatttcttattggttcaccactggaagttagacagcccagtgatgatctatttttgtagtctaaaaacgtgttgattaaacttccaacaattctttttctttgtcggcagtcattttatcaattgtcttgatagcatcatctgttactttttgaatatctttttcaagcgtcttcaactcgtcttctgtgatttcttttgctttttcagcttttttagcttcatccatggcatcacgacggatattacggatggcaacttttgaattttcaccgacttttttcacatccttcgccaagttcttacgagtttcctctgtaagggcaggaataaccaaacggataacagtaccgtcagattgcggtgtcaaaccaagatctgaagcgttcaaagcacgctcaatatccttcaagattgacttatcaaacggagtaatcaatagaacacgcgcttctggcactgtaataccagccaactggttcaatggcgttggagaaccgtagtactcaactgaaatacggtccaacaaactagcattggcacggccagcacgaatgtggctgaattcacgtgccaaactctgatgagattggttcatgcgctcttgcgctttagcaataatttctttagacataagacttccttctttgtatttttttacagtcttttagtttacttttagtactaggtaacgagccacaggcataaccgaagttagacaaggcgaattaacgaagtaataaaagaaaaactaaatgacgatatgatttatttttcttctgaagaatttgaaacggtagtaccgattggctcaccgaagacaacacgtttaatatttcctggttcattcatattgaacacgaccaaatcaatatcattgtccattgagagagttgatgctgtcgcatccatgattttcaaaccacgactaatcacttcacggtgggtcaattcattgaatttaactgcattagcatctttcttcggatcagcattgtagacgccatccacaccatttttagccatcaaaatcgcatccgcttcaatttctgcagcacgaagagccgctgtcgtatccgttgagaagtacggagaaccaataccagctccaaaaataacaatgcgacctttttcaagatgacgaagagcacgaccacgaatataaggctctgcaactgactgcatcgcaatcgctgtctgcacacgtgtatccacaccaagctgtttaagggaatcagccattacaagagcattcataacagtccccaacatgcctgtatagtctgcttgaactcgatccatacccgcttcagcagcaggctctccacgccaaaggttaccaccaccaataacaagggcaatctgaatacctgattctgcgacttcctgaatttcctttgccatttcctgaacagttttaaggtcaataccgacaccacgttcaccagccaaggcttcaccagatagtttgattagaatacgttcgtatttaggtttcatcatctctctcctcttttttatccctactattctaccacaaaaaccgttttttttatactgaaatctccaagaaaaaaggaaaatcctcaacgaactttccttctcacattctaaaacgcctctttttcccagcttttcaatagtagaaaatagagatctttaaaacaaactagcctaggcgcaatttcctccgtaaactctgagcccgacttccaattaaacgatctagctgacgagtcttcaatgtcaagatgacaaagacaagcatacctgctccacctgcaacagccaagtggataaagctagatacatagccatttgctggaaggataagattcaagacaaattcaatcccccatacaacgagtcccattacgatagaaatccaactaatggtcgcaatatcttttatcactagtctttcatcaatatgcagaaccttgtcaattcgcctatagaagaggtacagcataattcccaacccaaatatcgttgagataaagctaccatataccttaaagacatagatcattggtacttgtaaaacgattttcactagcatcccaatcaagaaataataaatggctcttctattttcaaatatcgcttgaatgaccacactaatgacagaatatagtcccagaggtaaaattaaaaataagttccaaataaatagagtaatggcgataggctctgacggtccgtaaaaaatcgtataaagtggcccagctaacaggactgttccaacaattgccggtatagtgaatataaagagtaattgtagattatccgccactaaatgagacgccgccttcaaatctttcttgacaaatttctctgtaatcaatggaatagcaacacttcccaaactaagtgaaatcccgataatcatcatcgtaatcttacttggattggcagccatatatgaataaagttccaaaagttccgaattactgtaatccgtaattctttccataacacgaataaacgtgacttggtcaataaactgcaataattgaatcgttagacctaaaatgataattggaatcgcatctcgaacagtttccttaataagttgacctgtatccaaagaaatcttttgtttcttagcatgaagcaacttaccaaggtaaccttgcttccataaagtataaactaaaatcccaacactagcaatcatcccgacaaaagctgcaaaggtagattggacaaccgcttcaagatagtcaccgctacccaacttcataatcataaatgttgctgccagtatccagataacccgtaccagttgctctgcaagctggctgatcgcatagggcttcatatcgtgccgaccttggaaaaaaccacgcaagatactcatggctgggaagataaagagaggcgggactagactatacatgactggaagtaacttttctttcgaccccgatgcgtctgccaaccacggagcacttagatacatgacccctgcaaagacagccccaaagaccaacatgagcttgaagaattctctgaccaagtaaagcgacacctcttctttacccaagacattgtatttagctacttgtttagcaatagctgtcggaagaccagctgttgaaatcaataagaagttggcatagatttgataccccatactaaagagggcattggcttcagctcgatattcccctaaccaaatataccagggaataacataagcaacaccaagcaggcgactaagaatatttccagcagtcaaccaagccaagcctctggccattgtcgcctgttctttggactgctgcatttcaactttttcggacatttttctattactttctatgtaaatataagacaggaaaaactcaattattaatttctatttttggattttcacaaagtctaactctttcattataaacttttatcataccaaagtaaaagaaaaacccacccataaggtgggcaagtcaattaattatcaattgaatgatatttcactgtcaaccctcgttgtacagctgggagctgagctattttatctacccaggtctttagatgcttgtaagaatcaacatctaaaaattctgccgaacctggatatagttctccttgcaccaagcgaccataccaagaccaaatagcaatatctgcgatggtataggtatttccagctatatattctcttgtcgccaatagctgatccaagagatctagctgacgcttagtttccattgtatagcgattaatcggatattcttgcgctgtcggagcgtaatggaagaaatgtccaaatcctccaccaacaaatggagcggcgccagtttgccagaagagccaattaagaacctctgtccgctctgcccaagcttttggcaggaaggcctcaaacttttctgccaagtagaggagaatattggctgattcaaagaccgaaatcggttcttgctcggaataatctaccatagctggtattttggagttggggttgatggcaacaaaatcggagccaaattggtctccttgaccgatattgatgagaaataggtcataatcagcttccgaaatacctaactctttcaactcctccaacataatagcaaccttaatgccattcggcgttcctaatgaatagacttggaaagacttctctccccttggtaggtcttgctcaaagcgactgcctgctgttggacggttgccagatcggttgtcattttcatcttcccacttccaaacgagtggttttgtatattctgtcatgttttctcctattttacctttcctggaaaaagactagcatagcgataatggttttgaacctcttgaaggtaatgggctagttgcaccaattccttaggcgctcggcaagtcagagctgttaactctgcattgataaagcgacttaagtgtcctgccagtatatagagattttcctccttgtccagctgacctgccacctccaatattttttcacgcagggcttctgaaaatgcttcctgcggaaggttgtaggctgcagaaaggtatttataaagctcttctttctctgctactttcatcggataactccttttatgtaaattgaatatagtataaatcgaaatcaagtgcttgtcaagaaaatctcaagaaaaaaagattgccctaagacaatctttctattgattaaagtgagttaggatcaactttgataccaacaccttgtgttgttgtaatagatactgaagtcatgtaagtacctttagctgtagctggtttagctttagccattacatcgtggaaagctttgaagttttcaacgagtttgtcagcgtcaaatgatactttaccgataagagcttgtacgatacctgctttgtcagcacggtaagtgattttaccacctttagactcttcaactgctttagcaacatccattgttactgtaccagttttagggtttggcatcaagttacgtggaccaagtacacgaccaagacgtccaacaacagccatcatatctggagttgcgataacaacgtcgaagtccaaccaaccaccgttgattttagcaacgaggtcatcttcaccaacaaagtctgcaccagcagcttttgcttcttctgctttagcaccacgtgcgaaaacaagaacgcgtgaagttttaccagtaccgtttggcaataccattgcaccacggatttgttggtctgctttacgtacgtcgatgttcaagttgtaagcaacttcaactgacgcatcaaatttagcgaagttagtttcttttgcaagagcaacagcttcttctacgctgtaaagttttgtgctgtcgattttttcaagagcagcacgcaagtttttactttttttagccatgttatatgtctccttgtaatcagataatcttgggtgctacttagtcagtaacagtgaatcccatagaacgagcagtaccttcgatcatacgcattgcagcttcaagagatgcagcgttcaagtcaggcattttagtttcagcaatttcttgtacttgtgcacgagtaactgttgcaactttagttttgtttggtgtacctgaacctttttcaacacctgcagcttttttcaaaagaacagcagctggtggtgttttagtgatgaaagtgaatgatttatcttcatacacagagataactactgggatgatcataccagcttggtcagctgtacgagcgttaaactcttttgtgaatcccatgatgttgatacctgcttgaccaagtgctggtccgactggtggagctggagtagctttacctgcaggaatttgaagttttacgagtttttcgacttttttagccatgatataaaatcctcctattgtggttttggcggtaattaaagatttttacctcccacaaatatgtgttttacacataccttttcattatacacgaatttcaaagaaatgcaagctttaggtttactttttttcacattttttatagaatgaatgtatgtttgaatcgattatatttttaaaaatagtagcctttctattcatctttctaaccttggccatttcgataattgctgtcaagttttttaggttgcaaaaccgaggatggaactttgcagacattgcctttcctctctatgcaattgaattttatctgatttcggacaaggcctactataacagtctactgcctcagcttgtcctagccctctcactactagcgattggtctttgcggtttcttccttttaaagaaaaagaattttttatatcgacgtttcttcaaggttttctggcgagctagttttatcttgacttttttgatgtatctagctttggttattgcggtcttcactttaaaatcctaaaatcatccatcctttcatagatggcataataaatccccattgcaggcgcagtggggattctttttatactaaatcagacaaggcgacgtagatgtatagtcgaatgaattagctttcagacaaggaactgaggtgcaggttgctagcacagcctagtggctgtgctaggttggagatataactttcaaagcaagtcacttctgcagagtacggcaagccgaaagtgacgatgtatcaaagttaattcaaatgactatagatagaactgaccttcatcaaatcaagtcaacagcgtatgattttgattttctaagagtattaattagttgtcatattgataggcctctctgggcatgaaaagatggacttattcatgaatttctagagggaggccatctggatcaaagaagaaggccatttttttaccatcaaaatcatctgttcgcaggacttcatgtcggatgtccaaacggtcaaactcttccagacaagcttccacatctgcaacctggaaggctagatggcgtaggcctgtatgttcaggattgggcatggccggacgcattggcgcatctggtttgatgaaaatttccaagatcagattgccttttttgacattgaagagaatatcatttttttctggtcggatatgttcatccacctgttcaaagcctagtttctcaacataaaattctcttgttttgccatagtcactaccgataattgcaatatgatgaactgcatcaaatttcattattgtgtttccaatacctttctaggttttgttccttcagctggaccaatgacacccgctgcttctagctcttccatgaggcgtgttgccctgttaaaaccaacagacaagcgtcgttgaatcatagaggcgctggctttttgtgtctcaactaccaaggcacgtgcttcgttgaaaagtggatctcctccagcatcaccaaaacctgcatcgccatcaccttctgccacttcacctggatcaaaggattcatcataatctgcatctgcctgatccttgataaagccaactattgcttctacatcatcatcggatataaaggaaccttgcaagcggactggatggttttcatcaatcggtttaaagagcatgtcaccgcggcccaagagtttttcagcaccattttcatctagaatcgtccgactgtctgtaccgcttgatacggcaaaggcgatacgagatggtacattggctttaatcaaacctgaaataacatcaacagatggtcgctgggtagcaagaatcatgtggatacctgctgcacgagccttctgtcccaagcgaataatggcatcttccacttccttgctggctaccatcatcaagtctgccaactcatctacgattaccacaattagaggaagtggaatctgtttttcttctgaacggctattaaattcttcgaccttcgcattataaccttctaagtttcggacaccaatttggctaaacaactcatagcgtttctccatttcatccactactttttgaagagctcgagcagccttgcgtgggttggtcacaacgggaatcaataggtggggaatatcattatagaccgataattcgaccattttggggtcaatcatcatgaacttaacttgatctggaccagctttcatgagaattgaagagatgataccgttgacagcaacagacttccctgaaccagttgaaccagccaccaatagatggggcatacgtgctaggttaaaggaacggacggaaccattgacagccttaccgagaggaatttccagaagtttgtctgggtctgttttagattgttcccagagctcacggaaaggtactgtagccacttcggagtttggaacttcaataccgaccagtgattttcctgggataggagcttcaatacggacatctttagccgcaagggctagagccaaatcatcagctaggttagaaatccgattgacacgaacaccgactgctggtttgacttcatacttggttaccgatggtccaatctcagctcgctcaactactaccttgattccaaaactggcaaaggtgtcttctaaaactttaatattctgacgaacaattcgtttttcattggactgactcttagcttttataggagcaaataagtctatggacggaagtttatatgctagtctctgcttaggcttgaaatcaatctgcacatctgtctcgtccttctcaaactcatttgtttcagaatcctggcttgccgagtttgattgtgctggttggtcatcttctgccaacataataggaaattcatcttctatgtctaagtggtcatattctgaaataatcggtacttgaacaggctcttcttcgaggatttcacccgtttctaaattgacatgtctatctaccagtgccaaagcccgagctgactcttcctcttcctctagacgaaggcgttcctcttctagacgagctaattcttgctgacgtttttcttctcgttctgcttttttctgtgttcgaagctctgctctttttacctgcgtctccaccaacttatctttggcaaccgccaagccatcggcaacatcataaacagaccatgggcttacaaaaaagataccaaatgctatcactagaagaccgatgaagaaggaaccgacatttgcaaagaggaaggagactggcagatagaagatacttccaatcatccctccgcctagaaatgctgttacctgaaacttagctaggtctgacaaggccaattttagagtatgaccgaataagtcactcccttgataggtccagtctaagtaagcctgaaattcaatcaataacccgataacaatcagccagaagcccgatatggtcccttctctttcgcgtaagactttgggaataagaaggtagataaatgcacccaccaataatagataggccagactaccaaataatagccggaaaatattgtagctggtcactccaaacacacctaggcgactggctgcaaaggcaatgaataaaagccccaatactcgaagggtgatatttttaacacgttcttgctgtgctaattctgccttggttggtcgcctcgtagcctttccttttttacttgtctttctcatagatacctcaactttctcaatctctttattttatcataatcgggaagaattttcatgatagaaaaaaccctgcaaatacagggtttctcttggagtgaaagaataatttaagagggcaaataatattatagagcgtttagaataatctgaccttctacgtagaaggttgatgtcaaggtttcttgaccatcgttaataaagatttccaaacagttggtgtcaaccaagacctctagctctgtcgcttgaaccgtgaccgctcgacgaacagttgaccattcctcctcaccaacttgctggattttgaggtgactacgatcaatatagacttcttgtttggctttatcatagccaaattgaagatagtctcggtcagtacccagtttcaagtctagactgtcgtccagtttgagggagagcttacttggtccttgaataacttgaccgatttcaatgtcgtcaaagctgttcaagatacctgctggcaagacctgcctgagtccattctcaccttgcttaagtagacgaggcagggtcatttgaccataccacttatggcctaggtcattggttacaagcggacgtccccatgtatgcatccaggcaatcatgacacgttccccttctggaccttcagtcgtttgagctgcatagaaatcatgcccatggtcgatttccttgaaggattctgccacaaagactttcttgtcccagtccacatgacccgtcacaaagatattggagttgatattgataaagtcattcccgtctttttggtaacgcattggagagataatcaggtactcttgaccgtccacttcaaagtagtcaggacattcccagacaaagccttggttggcctcacctttcaagaagatagactcaaatttccaatccgtcaggttgggagagctgagtaagacgatacagccgacattgtccttgtgcttggttgcgacaacagagtagtagtgaccatctttctcaaaaatcttcggatcgcggaagtcattggcaatcacttcttctggcagtccatctgctgttgcgactggattctgctcgattttttcaaagtgaataccgtcagtcgagaaggccatgttctgaacttgactaactgtcccgtcttcattgacgatgtgacctgtgtacatgagccagaggacatcatctttgacaatggcagagcccgagaaacagccgtctttatcgtaagctttatcaggagctaggtcaactggaagttgttcccagttgaccaagtccttacttttcgcatgcccccagtgcatcggtccccaaacactctcgtaagggttgaattggtagaacaaatggtattctccacggaagtagataaatccattggggtcgttcatccagcctgtttccggtgttaaatgggcttgtggtttgaaaatcggattaacgtttcctttttctttctgaataaattgattggcttctactactgttttcacaggcagcctccttttgattactgattttctttatactgatcatagtatttttgcttgatagctaaccagtcagaaagaccatagctttccaattctttcaaatagctatcccattcttcttcgataccgccgtttacaatccattctgcacgtttacggtagatgaagtcgttcatatctgcttcaacttgggcaatcttatccaaatcttcttgttccatgaagacgcgagggtaaatatcatcgtttgttacatagtcaagataggttgcgtgcatcaagtccaaacgccatttagcatcgtctggcatggttgttacggttccgtagtattcatcaagaatagccaacggtccaccaacttctgtcttctgacgaagttcacccggtgcggtaccctccaatggtaggtgtttcaaactattggttgctgtgtcgagttcaaaaatattttgttgggtttcatcaccataggtaccccagttgttttgaacagactggattggtttgtattgggcatcaatccatttagcagtcaattccaagtttttgttagctgaggtgataaccatgcggtcgcgttggaagcccataccgtttgtacgtgtgatgtgcttggttccatcaggacctgccaagactggcaagatgtcataagtatcgttcatacctgtaatgttagctttatcccaagtgaagtaaacaccgcatagattttcactacctttggcaatgtaagtattccaatcttgttcaaacgcttccgaatctagaagacctttttcttgaagggtacgcatgaactcaacaccttctttgtagtcttcgttgtctgctgtaaagtcaacggtaccgtcattgttgacaactaagtggtcatcgttatcgcctacaccaaaggcaccaaatagaattttaaagtcctcgttacctccaccattaatgaagcccatcggaatttcatcagccttaccgtttccatttggatcctgtgttttaaaggcttcgagaaccttaatcaagtcatctgttgtttttggcatatcaagtccaagtttgtccaaccattccttgttaatccaagcaatgtcattaacggtatggatagactccttgccctctcctaattcttcaatccatgggaatgagtagatatgaccgtctggtgctgtaatcatggaacggtactctggattttcatcaagaattttcttgaggtttggcatatgcttatcaatcaagtcttcaactggtacaataacaccttgtttagcccagttcatcaattccacatcagaagccccgtcattatggatggcgtctggcaaatcacctgaagcgatgtccaagttccgcttttcaccaaaatcagactggtagtttgtccaatcaatatgaacgccagtttcttcctctaaacgcttgaaaattaatttttcatttgaatcggctggagctagaggtgaactagctgtcataaacttaagtgtaacggatttttccaaagggaattgaacatctttcaattcataatcagggcttgaagcagtattttttgagccacaagcagccaataaaacggtacttgcaagaagtgtaacaactgtttttccaaatgtgtgtttcatcagaaacaacctcctgttttgttttctataaaaattttgaacaattttaaccttttagtgaaccagccataatccccttgtcaaagtatttctggaagaatggatacatgacaatgagtggcaagctagagatgacaatggtcgcatacttaatcatttctgcgattcgtttcatttcattcatggcagcctgggcaccaatcatgtccttagcaggctcgctttgaatgaggattttacgaagtactagttggagtggctccaagtctgggtccttgatgtaaatcatggcatcaaagtaagaattccattgaccgacaaaggcatagaggaagagcacaaacataattggcttagctagtggaatcatgattttccagaaaatctgaaattcattagcaccgtccattacggccgcttctaccaactcatctggcaagccttggaaataggtccgtgccaagatgatattccacacattgactgcaccaggaataataatggcccagacagtattcaacattcccaaatctttaaccaagagataggtcggaacaagtccaccaccgaagaacatagtgaagacaaggaaggcattgatccattttttcccgaccaaatcttttttagagagtggataggcagtcatgactgaaatagccacggtcacgaaggcaaaggagaaggaataaaagagggagttgaaaaatccgcgtaggatagacttgtctgaaaatacccgttgataaccttctactgtccagtcctttggatcaaagctaattcccttgctaagtaaggcctgtggatccatgaaggacgctactaagatatagaccataggcacaactgttatgagaacaagaaatgccagcaagattttattgacaaccagcattcgcttgtcaaattttgtgtacatttgtgtattcatacgaacctcctataagccttgtccgtcgttgatgcgtttgacaatcttattgactgcaatcagcagaataatattgataagtgcgttaaataagccaaccgctgttgaataagagtagtcccctgacaccaaaccgattttatagacataggttgaaatgatttcagaactggtcaggttgagggaagtctgcatcagaaaggctttttcgtaaccaacgttcatgatgcccccagctgctaagataaactgaatgaccataactggttttagtgctggtaagtcaatatgccagattcgttggaaaatatttgcaccgtctagcttagccgcttcaatcaaggctggatcaacattgatcaaggtagccgtgtaaagagtcgatgcccagcccattccctgccaaataccactgaggatgtagaggggtctgaagaagtctgggtctgtcaggaagttggcttcaatgccaaacatacctaggatggaattaaccggtcctcctactgagaagaagaggaaaatcataccgacgatgacaacgactgagataaagtttggagcgtagagcaccaactgaatccgttttttagccttatcgctcaatagttgattgagcatgatggccaaaataattggtagaagaaatcctaagagcagaccgtagacactcaatttcaaggtgttggcaagtaaggtgccgaaatttggagacgagagaaacttggtaaactcttcaaacccaatccactcactaccaagcaccccttttaaaggattatagtctttaaaggcaatcagcactccgtacatgggaatgtaacggaagatgaaagtcaagaccaagcctggtagtaacatcagtaacaagagtttctgttgcttgattctatcgaatagactagcttgttgcagttttgatgttttcataagaactcctttttgaaacgtttcatttttcttgtgaaaataaaaccaactgtttattgatggttttattttacaattgtaaccgttttctgtcaactgcttttttaaaaattttttgtagtttttccttcaagataggaaatcggtagagtgacttgtagggggcgctctcttttctcaataatatcaattagacaggcaacggcttcttgggccatagactccaaaggttgacgaatggtcgaaagggctaaagatttttcacttgccaactgaataccatcatagccaatcacctgcacatcttctggaacccgtcgtctcagtttttccaaaacagcaagtgtgtctagggccgtaaaatcattgatggtgaaaatagcatcaacctgtggattgttaatcagaaactcttcgacttgaccgacaaagtcatcatatggctcttccaagtccaagacatgacaaggaaaacctgcctctaaaatcctcttttcaaaatacaatctacgcttcttggtttcattgattgttttattgtgcccaccgataaaggcaaaatggcgacctccttttgctatcaaggtattcgctgccagttccgcaccagctcggttgtccgaactgacacaagggatagccttattttcataggtgcggtcgatactgacgaatggaatgttagaagataagtaatcctcgattggactgtaggtgatagcaataatgccgtccaccttattttgttgcagcatagtcagataatccaactccctttttggaccagaaatattgcaaaggagcaacttgtaatttttcttactcagttccacttcaacatgataggcaaattctccaaaaaaaggatgccaaactgtcggaataatcaaggcgatagtttcggttttgttcttcttcatgccacgagcataaacatctggaatgtaattcaattccttaatggcagcattgactttttcaagcgtactttccttaatacctggctcattgttgataactcttgaaactgtcccaacactgacccctgcaactcgagctacatctttcatagtaattgatttttgttcttccatggtttacccctttcttttgaaacgtttcaataatttacactagaatatcattgatagcgttttctgtcaagaaaaattgacttgttagcaaataaaaacacccaaaaagctagaatgattctaacttttgagtgccgtttaaaaatcttttctattttatttgtacatcttcttcattgggtgttttgcaagcacttctgggtgattatcgagtgcagctctgcctttttccgtcagggcataacctcggacggtaaagtatggagctaacttttcttccgtcaagttgtccttgagggcagtgtcgaggtctgccgccttcatcttggataggcctgtcacaccctctgctttgaggatatttttcttggcagtagaagtgatgtggtctagggaatcaaaggccgattccacataggcataaccgtctgcgatcaactgctccatgtgagcaggaccattgataccatacatgtactcaaagtacttggagtagggcgtcgtcgattcaaaagaacccaggctaatccgccatagcaaaataatatctcctggcaaaataccttcttccagacgaaccatattgcgtttgggaacgggcttggcctccaacagccaggctgccaagtcacgctcgggggaaatatagggtttgacctcgtggtctttatacatttcttcaacacgattctggagtgacatttactttacctcacgaattgcgtaataatttccatcattgtctgcaaagctaattaccttcatgaaaccaaggtccatgactggattcgttgtgacaccacgttcaacaagttcttcgtaagttttggctacatctactgatgtcattaagattgatggtgtacctaagtttaattctggctccatctcagcaacctccgccttatcatgaagtacaaattgtacctcactatctgatttaggtgcaataatgtaagaagtttgggggccttgcacttgtttttctacacgttcaaatcccattttctctttccaaaattgagctgaagcctcaatatcattcacatataacataacttgtccgattgattgaatcatcttaaatacctcttttgcgttgtacgaacatgtgttcaaaccattatacactagatagggatattctccaaagaaaaacgactcttagagccgttcaaaacctaggaaacgagtcccctgaaaatgcagggtgcctacatctctctctgctaaaagggcatattcatctgaacgaaggcgaaattcctgccgttttccctcccattcaaacgttacataataattggttcgtgctacttcgttaccaaaaacatgggttcgtttagagacaagcttagccttgcaagattctttgggcgcccgattgttgtggtgccattccataaaatttttaatgatatggaaacaaactgtcgctaatatgattgcggaaaaactgtagaaaagggccgtatgccatactaggcttccatctgggtcaaacaagttctcaaacatcattattctccttttacatctttaaatatagtatatcatattattgttttagatacgctttttatactagataaaaattgaaaaaatccatatttcatggtagaatgagcataattttgaacaagacaagaaaggattttcaatgaaaaaaatactagttcttgctctagcttcgagcatcttgctaactgcctgcacaaacaactcgacagctaatagctcatcttctacagcatctagttctagtccaagctcgactacgacagctgatacaactgcttctagccaatatgccaaagatttggcatacgccattaacaatcccaaagctacattcccccaactttccaatgaaattggtgaaaatgaggctgctattaaaataaaaacaaccgaaggcgacatcactataaaactcttccccgagcaagcaccactaactgtggaaaactttctgactcatgcgaaggaaggatactataatggaacgatcttccatcgtgtcattaaggatttcatgattcaaggtggcgatcctcttggaaatggtactggtggagagtctatctgggccggaaaagatactactatcgatgctggaaatggttttaaagacgagatttcagctttcctctataacattcgtggctcactttctatggcaaacgctggcgcgggaacaaatggaagtcagtttttcatcaatcaaaatacaacagacatgtctagccaactctctagttctagctatcctggtaaaatcattgacgcttataaaaacggaggcaatccaaacttagatggcaagcataccgtatttggtcaagtcattgaagggatggacatcgtggataaaatcgcttcagtcgaaacagacaatagcgataaacctaaaacagatgtaaaaattgagtctattgaaattctgaaagattacaccttttaaaaatgggttctataatttctgtagtgggtaaaaccaccgtggagattatggagcctttttgagtatagaaaaaaagtcccatatgacctataatgaaaagcaaccacactcacattagaaagactcatatggaacaactaaatcttatcacaaattttctcagaattaaagacaaaaatatcactatcactgatgaatatgatatgggaactcacttagaactccacggttacttggattacatggctcctaaatgtccagaatgcaaaggacaaatggctaagtacgactaccagaaagcatcaaaaatcccttacctagaaactgctggttatccactccttatccgccttaaaaagcgtcgtttcaagtgtaaagaatgtgggaaaatggcgggcgctgaaactcctcttgttaagaaaaaccatcaaatctccgtcgctgttagtcagaagatcgctcaattactcatcgaaaatcaagcaatgacacatattgcacacaggctatctatctcaacatcatcagttatgagaaagctcaatgagttcaagtttgaaacggattggaataccctacctgaagtgatgagttgggacgagtatgccttcaagaaggggaaaatgagcttcatcgctcaagatttcgactccctaaacgtcatcgccattctcgacggaagaactcaagcaaccatccgaaaccactttctacgctatcctagaaaggttagaaatcaggtcaaagtgattaccatggatatgtttagtccctattatcaacttgctaaacagctttttccgaatgcaaaaatcgtactcgaccgctttcatattgtgcaacaccttggccgtgctatgaaccgtgttcgtattcaaattatgaatcaattcgacagaacctcgcaggaataccgagccttgaaacgctactggaaattgattcaacaggatagtcgtaaactcagcgataaacgattttatccccctatgtttcgaatgcatttgactaacaaggaaatactggaaaaactcctgtctttctccgaggaactacgacagcactatgaactctatcaattgctcttattccatttccaagagaagaactcagaccatttctttgacatcgtcgaactggaaatagccactgttaatcctattttccagacggtatttaagacatttctaaaggataaagacaaggttttgaatgccctagaattgccttattccaacgccaaactggaagctactaataatctcatcaaagtcattaagagaaatgcctttggtttcaggaactttgagaactttaaaaaacgcattttgattgctttgaacataaagaaagagagaacgaagttcgtcctctctaggtgttagcttttcatctacccactacagttgacaaagagcctaaaaatgaagctgggcaagacatcatagatgtcttgcccagcttcatgtattctatcatatccttttatagttatctttatcaaggtaagctgattaccatcagctctcatctaccactagaaaaagttcactgaacctcgacgcagtaggcgtcacaacaaatcactcttcgcattgctcgagttctttggacgccgcccttgcgagggaaagacgacgaaatcaaatcaactttgttgattactgatttctgtctttccgctacatcttctcttccaactccacatccggatacttgtccgcgaaccagcggagggcgaagtcgttttcaaaaaggaaaactggttggtcaaagcggtctttagctagaatgttacgacttgatgacatgcgttcatccaggtcttctggcttgatccagcggactgtctttttacccattggagccatgactacttcggcattgtactcgccttccatgcggtgtttgaaaacttcaaactggagctgaccaacggcacccagcatatactcgcctgtctggtagttcttgtagagctggatagctccttcttgcaccagttgctcaattcccttgtggaaggatttttgtttcatgacatttttggcagaaactttcatgaaaatttcaggggtgaaggtcggtagcggctcgaattcaaacttgttcttgcctacggtcaaggtatctcctacctgataagtccctgtatcgtaaaccccgataatgtcacccgctactgcattttccacattctcacgggactcggccatgaactgcgtcacgttggacaacttggctcccttacctgtacgaggcaggttaaccgccataccgcgttcaaattcgcccgaaaccacacggacaaaggcgatacggtcgcggtgacgagggtccatgttggcttggattttgaagacaaagcctgaaaaatctttattgagcgggtcaatgacatcccctgtcgttgtcttgtgaccatgtggctctggagcaaattccaagaaggtgtcaaggaaggtctgcacaccaaagtttgtcagggctgagccgaagaaaacaggtgtcaaatcgccgtccaaaatcgcctgttctgaaaattcattcccagcttccgccagaagttcaatatcatccagaacttgtgcataaaaggggttagaaccaaagagcttgtcaccctcgtccaagcttgcaaaacgctcatcacctcgatagagttctaaacgtttgttatggaggtcatagagtccctcgaaggatttccccataccaatcggccagttcattggatagctggcaatgcccaagacttcttccaactcctgcaacaaatcaagtggctcacgaccgtcacggtccaacttgttgataaaagtgaaaacaggaatgttgcggtgcttaacaacctcaaagagctttttggtctgggcctcgatacccttggcagagtccaccaccatgacagccgcatccaccgccatcaaggtccgataagtgtcttctgagaagtcctcgtgccctggtgtatctaggatattgacccgcttgcctgcatagtcaaactgcatgacagatgaggtaacagagataccacgttgcttctcaatatccatccagtcagatttggcaaagttaccagtctttttccccttgaccgtacctgcttcacgaatctcacccccaaagtagagcaactgctcggtaatggtggttttacccgcgtccgggtgagagataatcgcaaaggtgcggcgtttcttgatttcttcttgtagtgacataatgtttccttttcattttttgtattttgattcatagcagagctgagctcttatcctattcgatttacattggattcatccttattctttactagacaactctcttattatatcggaaataagggaatttttcaaactattgaagaataggtctacagacctatactattgtattataaatatgttacaataagtatgagatgtattctatatactagaaaaagaaagataaaataatgaacaaacaaataaaaggtttatcaaccaaggaagtacaagaacgtattcaaaaccagcaaaccaatcattttaagacaaagaccagtgccagtaattgggaaatcttcagacgaaatgtgtttacatcttttaacgcactaaattttgccattttcttagccttactagctgttcaggcatggtccaaccttttcttcttcggagttattgtcctcaacgctgtttcaggaatgctgacagaatggcgagcacgacgaatgattgacaaactcaacctgatgaacaaggattttatccgagttgttcgcgatagcgagacaatatctattgcaccagaagatattgtcttagatgatgttctcttgctgtctgctggcgaacaagttcctagtgatgctattgttttagaaggtatagccgagacaaacgaggccatgttaaccggtgaaagcgacttgattgtgaaaaatactggggctgaattattgtctggtagctatctagttagcggacagatttatgcaaaagtcatccatgttggcgcagaaaactatgccaataagctcatgcttgaggcgaaaactcacaaacctatcgtctctcgtattctttacaatatggataaaattgctaaatttacaggaaaaattatcattccattcggacttgctctttttctagaagcctttttcatcaaaattcttcccttaaaagactcagttattaccagctctactgccctactaggtatgttaccaaagggaattgctctgctgaccatcacttctctcttaactgccgttatcaaactgggaatgaaaaatgtcctcgtacaagaaatgtattccgtcgaaacacttgcccgagttgatgttctttgtttggataagaccggaacgattactcaggggaaaatgaccgtcgaaaacctgctccccttaaccaaccattattcacttgacactatccaacagatactcgctacctatatccagacaagtgaggatactaattcaacagctcaggccattcgaaaagaatatggtgatttagagcaccactataaagctagtcacatcatcccattttctagtgatagaaaatggggggcaatgacaatagaaaacattggtcacatttttctaggggcaccagaaatgttactaacacaaaatcctccttctgtttctgaggcacaggctcgtggttcccgtgtcctgattcttgcgcttagccaacagtcccttctttcttctcaaaatcagctacctgagaatattgaacctctagctctattagaaattgccgacccaatccgagaagacgccgcagaaacactggcctatcttcgctcgcaagaagtgacactaaaaataatctctggtgacaatcctgtgacagtctcacacattgccagggaagctggatttgctgactacgatagctatatcgattgttccaaagttgacgacgaagaactaattgccagagctgaaacaaccgccattttcggtcgcgtatccccacatcagaaaaaattgctcatccaaaccctcaaagcacagggacatactactgcaatgaccggtgatggggtcaatgatattcttgcactacgcgaagctgattgttccattgttatggcagaaggcgatcccgctaccagacaaatcgctaatctagtcctcctagattctgaatttcgcgatattcctgagattctctttgagggacgacgcgttgttaataacatctcccacattgctcccatctttcttatcaaaacaatctactctttcttacttggccttatctgtatcgctagtattgccctaggtaaagcagaatatttgttagttttcccatttattcaagtacaaatgaccctcattggtcaatttgtcgaaggttttcctccttttatcctaacttttgaacgaaatatccgccctgtagaaaaacattttctcagaaaatctcttctcttagccctaccaaatgctctcatggttgttctcagtgtccttattttccatttaatgcaagtatttggatacttaaacttgcatgacatgcaaaccctttcttattatgttcttggttcaacaggtctactggctgtcattcgtgcctgtttgccactgacaaaagctcgactggctcttattatttattccgttttcggtttcttcatcagctcccatttcctacatggtctgattgaaatccaccccctaaacagtcacacattgccaatctattctggattaatgctcatttttatccctgtctttttctggattagctacaaacaaggcgcatttaaaaactaaaaataagacttgaaaaactaatttcaagtcttattttttcaatatatgcgaattcatttgtttgctttcttttttcaaataggcaatcagcatagcttgtatactcaaaatagagaaacagagtaggcaggttaccaagaagaaattcaaaggaagattattagtattcactaaaggtgcctgtctcaaaaatccataatttccaccagttaaaagagctactcctagaatcagcatattcataataagcgtatatttcactacctcttttcccttcaacatctccccttctaaatcagataacaggtacaacatacaattaaccgtcaaggcgtagtgaccaataacaaaagtaaagaaggtcagatgtggaaatgcaaatgggtcaaatactggatgaataaaggccgcaagcgatccaaaaagaccgagataggcaaaataacgtttcaaaggtccgggcttcgcccaaagaataaagagcatggccaagcgacaatgataaaaaggaagactctctgaaagaggagaatcagctacgatataccaagtataaagggagacaatctgtataaattgaagccaccaaaaaacaatatgaaaccatcttttttgataacaacgaaaacaaagatggagcatgaaaaaccaaataatcatgagaaacagatgttccaatacgttcaggttcggtgcttcagaaatctgattgctaaaaaaatcactcatcttattaaaatcctctctttcctcaaaagttagtatatcaacttttcgatgttttgacaagacttgctaaaaaagagaggtctctcctctctacttttctattgcttccactactttcccaagattcatggaattagagcctttaaagaggatttggtcctcttttcctagactttccctaacctgtttaaccagatcttcaaattgatcctgctctgcatttttcctaaagaaatagacttttccaatcgggaacatctgactagccaactgggccagaccttcaatatcctgaccgtagaaaatgacggtgtctagcacatcaggcgacaggctcaaaatcatctgattgtggagatcgacggactggctccccagttctttcatatctgctaaaacggcgattttcttgccgccttcgtttgcaggaatgctagtgaaagtttccaaaatcaatcgcatggccgttgggttggcgttgtagacatcgctgagaatatctgctccgtttgctgccttcttccactcggtgcggtttcgggtcaagtttagactggctagggctgacttgattgcctcatcaggcacacccaaggtcttacctacgtagcttgctaccatggcattggtggcattgtacttacccgttactgggaggaaaatgtcgccgtccataaaattgacggtgaaggtcaggctatcttttgactcgaccagactggtcacctgcaaatcagcctgctcaccgaagcgaatgaggtctacatggctcggcaagagcttatccgcaatcggatctgctgggatcaagagtttactacctggctccattccatctgcaatctgtaattttcctttggcaatctcttctcgtgagccgaaaaattctaaatgcgcttcaccaaaaagggtaataactgatagacttggtttggcaatttcggatagaagatgaatatctcccaagtggtcttggcccatttccaagaccagtttttctgtatcatcaggcatgtggaggacggtgtatggcagaccgatttcgttgttgtagttgccttgtgtcttataagtcttgtaagtcgtcgccagaacatcgtgaatcatgtccttggtggtcgttttaccgtttgatcctgtcacagcaatgacttctacccctgttttctctaggtagtaagccgctaattgttgaagcgcagccaagcagtcctctactagaatgtgaggaacatcaaggctaacttcagacagggttactacgcagccattttcaaaagccacaggaataaagtcatgaccgtcacgcgcacctttaaggggaacaaagaggtcgccagttgtgacgagtcgactatcgaactcgaccttgttgaatgcagtatcggtataaagactaatatcattttttgcgcccaagacctgagcgacttcgtgtagggttaatttcattgttttctccaataaactaaaaaagagctttcgctctttctattataccactttttatcgaacttgagtgaggacaccatctttcatctcataaaccttgtcgcatttcttcaattgctaaaaacatcttactccacactttctaagacataaaaacttgtctcaaactgcaagtcttccctcaaaagagctttgactttacatttcttttccacataggcaagaatctctttctgcttctgcgctgaaaccgactcaccaattccaatcaacacctcaaaacgctgattgtccaagcgactctccacctgaacaggcatggttttattgccttcttggctggcatagtagccctgcacacacatggtgatacaggcagctaagccaatattaactagactaaccggagtctcacccttctccgttaccccaaaggtacgaaccgattcgccatatccttgagaaagagcctgaaacagaccttccccttttactgtcgtttgatacataaacacctccagaacttgttccattttatttctttttgcaaacctttgcaagaaaaaagattggaatgattccaatcttgataataattaaatgaggtgactttcgcgtttttcaaacatttccttagccaaacgaacaagctcttcaatcaagtctggataagctaggcccatattatcccaaaggagtggatacatagaccattgggtgaaacctggcatggtattgagttcgtttaggaagatgtcgccgtcttcagtcaggaagaaatcacagcgagaaagtccacaaccaccgatagcacggaaggccttggcagcattatcacgcatgatatccatgatagactcatcaatcttagctgggatttccatggtgattttgttgtcgatgtatttggcatcgtagtcataaaaagcaacgtctttgactacttcgccaggaagtgtcgttttcacgtcagcatttcccaaaagaccgacctcaatctcacgcgcattaacaccctgctcaacgaggacacggctatcatacttgaaggccagatcaagtgccttacgcaagccagctaaatcctcagcttttgagataccgacacttgaccccatattagctggttttacaaagaccggataagtcaattttccttcaatctctgcaatcttatcgtcgatattttcaccctcgataactgccacataaggtacctgggagattcctgctgattcaagtacgcgcttggtagtgattttgtccatagcaacgcttgaagacaagatattagtgccaacataaggcatacgaagcacttccaagaagccttgaatagatccgtcttctcccattgggccatgaagaacagggaaaacaaccgccttttcttcataaatatcgctcggacggattttttgctcttcaacaatcgtcgcgtttgtcatgagtttttcatcggcagacggtgtttgagaaaactcttgcgtcttaataaagtccccggtctggctaatgaaataggttttgacaaaaaatttatcataattgatagcacgcatgacgctttcggcagacagaacagatacctcacgctctgcagaacgcccaccatatagtaaaatcaaggtttcttttgacatatattttccttcctgtatcaacgctattactcttagtatagcataatttaacaaatcatagctatcctatctcaaaattaggaacgtatctaactacagaactgctatagctctgtgcggttttcaatagccctcaacagggtcacttcatctgcatattcaatatcactgcctaccgctaagccacgagctagtctagttactttgattccagcaggtttaaggacacgtgagatatacatggatgtagcctctccatctgctgttgcattagtcgccacaatcacctctgtcacctcattttccatcaagcgggtcagcagagttttcaggttaatatcgtctggcccaatcccgttcataggggaaatcaagccatgcaatacatggtagagaccgtgatactcttggatattttccaaggctgtaacatctcgactatcctctacaatcaaaatagtagactggtctcgcgttgagtcctggcaaatggcacaggggtcctgatctgtcaaattaccacaaatggagcaataagataggtctcgcttggctgccaataaattttttgcaaactcattaacgacatcatcctccatgccaatagtataaaaagctaaacgggtagccgtttttataccgatacctggcaatttagaatagctatcaattaacttggcaataggtgtagggtaaagcataagcctccttaattcattgggtgaagtgattgatatagattgataatttcttgagtaattgtcttagtagttgttgaactttgattggtcaagtttggtaggacaactgctaccgcaatttgaggattatcactaggcgcataagcaacaacgttggtattgaccgcagtaaccacatcaccagaagctgtcgttgtgtaggtttcggctgtaccagtcttggcactgatggtcacggccgcaccacgaccgatagcactacctgtattaaagcgcccactaccattgacaacttggtagaaaccttgacgaagaagagacatatcctcagcggaaatattaacctgattcatctccttaccagatacggtttcaattaattcccccaaaccaccttgggcattattcccataaattccctcaacgaggtgtggagaaatccgtgtcccgttattcgcaatggtcgctgcatactgtgccatctgcatcggtgtatagttatcaaactgtccaaaagcgttggtaataaagttggctgtcgtatacttatctggtaaaaatcctgtagattcgagtggaaggtcaatacctgtagaagcaccaagaccatattctgcaaaagtcgaacgaagcttagtcatggcgtttttcaatgtatcaccatcattcaaatacatgttagctgagtaggtctgaccgagtagtcccaaagcaatcttaaccatatagatgttagaagaatattccagagcctctgtcgcatcaatattaaaactaccataggccccataccaagatgtaattggtgctgaacctgcaaaatagattggttcatctaattgaatctgattaccactgataactccattttcccaaccagagctgattgtcgctcctttgacgatggaacctggtgtaaagacacttgtaatcgtaccaagagcatcctccgtaatagtacttgagcctttttcatgactatatcctgacatagcaagtactgcacctgtagaaggatttaatgcaactgcataaacaccttccgagtaaagcgcactaccagtagctagctcactttcaaagtattttctcaaaatagcattgaccccatcttgaaaggctaaatcaatagtcagtttaatattatttccctgctgtccttcttggattgtctcaatactttcgatatttccatttctatctaggtttatttgttttttctcacgttgaccttgcaagacttcttcatattgtttctcgaggtaggcagttcccacacggtcatttgaagagtagcccttggatagatagtattctgcatcttctgcaggcaaaccagcctgttcactcgttactgtaccgataatggagctgagggaagttggtaaaatcgtccgttgccagttattggtcgttgaaatgcctggaagttgactttcattggctacgatatgagcaacctgttcagaagtcagagtatccgttaccaaattaacagtagagaagtaagtagctccattcatctgcttgaagagttcaatcgctttattgtcttgctcagaatattgtaatgcttcggcagggatactatcaactgcattagaataaattgttgattcgctcaagtagttaccatcggaatcgtattttttatcttttggcaaggcctcgactacctgacgataaacctcttcatctgccaaataataatcagccttatcacgttgagtaattgttacgtctgaaacattgacccactgcaagagtttattagctacttctttcatttcctgagcagacatcttgttgggacgtgtgaaggagacgacctgctgaatctcgttttcaaccaaaggttttccctgcgcatcgtaaatctgcccgcgaatagagccattgctgatgattttctgactggcagtagacagcttattactataaaaatcatgattgatgatctgcatatctgccagacgcaatatcaaaactaggaaaaggaaaatcacgatagaaaataaaatatttaaacgaagggaaataaaatttccatcatgttccaaaggcttgttctttctttttttcacttcaaagacctcattctagaaatatccttcttattataccacaggcaaaaaatattttttagacagagcctccttttcagaaaatattttcttgtgatttcttcacgagacaagcttgcactatctcccattgactgtgaacagatgtttccacaaactgttgatcatgggaaatcaaggggacacttccttcatattctttcaagaatgtttccaaaacctcaatagctgccatatctagaaaatttgtcggttcatctagtatcaaaagatttgcatccgccaacaataccttagctaaggagagacgaacacgctcaccaccagacagatttgctaccttctgctgagccttatcgcaagaaagtcctaacatacctaataaattgagaatcatcatcctatcttgaagagaggtacaactaacattttcaaaagcagtcttttcttcatcaaggtttatcaaatcctgtgcaaaataagcaatttttaacttaggattataatagcctgctaattctttcctaaataattttcggacaaaactagtctttccagaaccattcgcccccactaaggctaacttctctccaaacgtcatccctatctgagggacatcaaatagatacacttcatccatcaaaacttgaccagcctgcaagcgaaagagactgtgaagacccgtatccaaggcacctttcgcttccatctttacccacgtttcctttctaggttgttcaaccttgtccaaacgctctatccgtttttccaaatgcttggcagtcttggccatagacttggcttgactatcataggaccccatcatggcactgactttccactcagacgatatttagaataaatgtccacattcacttctcaaagttcgcgtcaacatctcagcgcagtggttgattggcagatttgttcgtttcttacactccaaatctgacctaatcaactgtgcgggggtgggatgacgaagtttttataattggttgacttctatcccactccctctcttccccatcttctgagccttggcttgacgttcatgttgggcttttttcatttgggcaacttttttctgataggcttcataagactcctgctgtccttctcgcctagcccggcgactttctacaaacgcctcgtaatttcctagataaacctgaaccttttcttcttctaaatgccaaatgtgactggctatttgattgagaaaatgccgatcatgactaacaactagtagactacctcgatagcgtttgatttgtttgattagcttttcctggtgttcttgatccagattggcagtcggttcatccatgattaacaactgtggtctttgggcaaaagcctcttgaatagacttccaaacctgttccccacctgaaagcgagctcctttcctgtaactggggtacataggcccagtctgcttttacctcaatctgaccggcaaaatccctatccagtcctagtaagattttcaaaaaagtagacttgccaactccgttatttccaaccaaaccaaccttttgaccagctagcttgaaggctcaactgcttgggagcaggaaagaactcgaccaagataaaaagagttcgtcttcccgcccccgcacagttgattaggtcagatttggagtgtgtgtgaagcacgaacaaatctgccaatcaaccactgcgctgagatgttgacacgaaccctgagaagcgaggttaagctttttgcccagcctctacgtcccgcaaattccttctctaatcgaatacattttattacttccatatagacctcttttcttcacaaaaagggccccaattctgcaaaatggacacagaaaaaagccatgcaaaacatgaccattccctatgggaaaagtcacacgaatagtaagcccttatgagcagtcttatcccttgtatagtcagttaatgtaacctcaccacaagttttaagagcaactaataagtagcttaattattcatgtaacttcacctcgtataattagtaatttcagtataacttagtttgtatcaattgtcaaatcttggtcaagggagtcgctgtatctggcgatgtgtcatagacttggaaatccactccaactcctaaatcagcctgcgccaactgattaaccatggtcatgtgagccaattccttgatattgttttcctttgacaaatgccctaggtaaatctttttggtccgatttcccaacgagcgaatcatggcgtcagctccatcttcattacaaagatggcccttatctgacaaaatccgttgcttcaaattccatgaatatgaacctgcgcgcaaaatttcaatatcatggttcgattcaatcaaataagcatcggcattttctacaattccaaccatgcggtcactgacatagcctgtatccgtcaacataacaaaggatttgtcatccttcataaaacggtaaaattgcgggcatgcagcatcatggctaactccaaatgactcaatatctaggtcgccaaaagtcttcatagcacccaattcgaagatatgtttttgagccacatcaatcttgcccaatttgctctccatagcctgccaggtcaattcattggcataaatgtccatgccatacttacgtgctaaaacaccgataccatggatgtgatcgctatgttcatgcgttaccaggatagcatcaatatcctcaggctttcgatcaatttccgccaaaagactggtaatctttttccctgataagccagcatccactaagattttctttttatctgtttctaggtaaaaacaattcccgctggaccccgaagctaaaatactataattaaaaccttttccgatcatattctcctattcttcctcatctgaatcatcccactcatctagtgcgatgtccttgctatacggcaagacaattgtaaacgttgagccatgaccatattcgcttttagcccagataaagcccttatgttgttttacgatttcttttgcaatagctaaaccaagacctgtaccaccttgggcacgagatcgtgccttgtctacgcgataaaatcggtcaaaaattctaggtaaatctgctttcggaatccccagaccttcgtctgatacggatacaatcaactggctatctgtggtcttcatgctgaaggtaattgtcccgccgtctggcgaatatttaatggcattatttaagatattatctaaaacctgagtcatcttatctgtatcaatctcaacccaaataggactgatttgatagtcacgaacaatcgtatagaccttatctgaatcagcatttttcatttggtcaaaacggttaagaataaaggtcacaaaagcagtaaagtttatcagttcgacatctatctgaccaacttgattatcaatgcgcgataagctaaggagatctgtaatcatccgcatcatgcggttggtctcatctaaggataccttaacaaaactcggcgccacagactccgtcagcgctccctcatccagagcctctagataggatttaacggaagtcaatggcgtacgcaattcatgactcacatttgacacaaacagcctacgttcccgttcttccttggcctgctcggtcatatcatgcaagacgacaaccaggccagaaatcagaccactctcactacgaatcgttgcaaaattagcgcgtaaagtcagaaattcttcgttttcattggtgtgatcaatcacaatctcaggtgtctgagccaacaaatctctcaatgtataacggtctgataaatctaaaacctctagcaggtgatactgctcctgctttgggttagataaccccaactgtttctgggccatatcgttaatcatgatgatccgtccgatacggtctgtagcaataacaccgtcactcatataggacaggatggacgtcagacgtgtcttttcttgttctaaattatcatgagttaagcggatgacctcggacaaatcattgagggaattagccatgtctgtgatttcaggacttcccctcatgtctaacagatctgcataattcccctcaattaaggcattgactttttgattgagttgtttaatttgcttattatcccaatagttttcaatcaaaaggaccgtcagagcaattagaaagccaatcaaaatgacaacaaaccaaaattctgccgtggtcattaaataacgtaattgattaatcatttccttttataaaatatcccactccgcgacgagtaagaatgtattctggtctgcttggtgtatcttcaattttctcacgcagacgacgaatcgttacatccaccgtgcggacatcaccaaagtaatcataaccccaaactgtttccaatagatgttctcgagtcataacctgacctaagtgtttggccagatggtggagcaattcaaactcacgatgggtcagctccagctctttaccatgcttcttagcaacaaacgcatcaggcagaatgaccaaatcgccaatcaccaactctggagttcctgttgactcaatatttgtctgcgtctctgccaattcactacgacgaagaagagccttaacacgcgcctgtaattcgcgattagagaagggcttggtcacataatcatccgcccctatttcaagcccgataaccttatcaaattcgctatctttagcagataacatcaagattggaacattgctggtcttacgaatcgttcgagcaacctctagtccgtccaattctggcaacatcaagtccaaaatgacaatgtcaggaaactcagcctcaaatacttccaaggcttcacgtccatcgaaagctgtcacaacttcatatccctcacgcgtcatattaaacttaataatatctgagattggtttttcatcatctacaattaatatttttttcattagaatcttacctttgctttatttcttctattatatcagacttacctaaaaaattcatatttcaaaaccatctgacacggtgatgtcacattttataacatacaacacattaaattgtcagaatttacttgacattgtatataggcaatgctaagatgggaatacctaaaaaacagtatgcaaggagaattttatggctttagtagaatttaaagatgtcaataaatactatggtgactaccacgccctacgcaatatcaacttggaattcgaacctggacaggttgtcgttctccttggaccttccggatccggaaaatctactctcattcgcacgattaacggtttagaggcaattgatgaaggaacgctcatcgtcaatggacatgatatttcctctacttctatcaaagagctcgtatcacttcgcaaagaagttggcatggttttccagcatttcaacctttacccacacaaaaccgtgttagaaaatgttaccttggcaccgattaaggttttgggaatcaataaggctacagctgaaaaaaccgctcaaaagtatcttgaatttgttaacctctgggatcggaaggattcctaccctgctatgctatccggaggccaaaaacaacgtgttgccatcgctcgcggcttagctatgaaacctgagcttctactcttcgatgaaccaacatctgccttggacccagaaactatcggagatgtacttgcagttatgcaaaaattggcacgtgacgggatgaacatgattgtcgtaacacacgaaatgggctttgcccgtgaagtagctgatcgcatcatcttcatggctgagggagaagttttagttgatacaacagatgtgaatggcttctttgacaatccgacagagcctcgtgcccaacaattcctcagtaagattatcaaccacgaatctgacaaagtaaaactctaggaggaagtctatggataagaaaaaaatcaacattttctttgcaattagattattggtctttggacttattcttctcgttttcgcaaaacaaccagtagctcaaacagaaacacccgcatccattactaatagtgatcaagttcaagctatcatcgatagaggcgtgctccgcgtcggagtgaaacaggacgtcccaaactttggctacaagaaccctgatactggtgaattcgagggaatggagattgatattgctcgcaaaattgcagacgaattaggtgtagatatcgaatttactcccgttacagcgcaaacccgaggaccacttcttgataacagtcaagtggatatggtcatcgcaacttttaccatcactgaggaacgtaagttgctctacaatttcacaactccttattacacagatgccgttggcttcttggtcaataaggatagtggaattaagacattcaccgacctggatggaaagacaatcggtgtagctcagggttccattacacgtaccctcatctctgaactagcagacaaatacggtatcactgtcaattttgcagagcttggttcttatccagaactctctgtctcgctacgtgctcaccgtacagacgcattttctgtagaccaatctatccttgctgggtatatcagttcgaaatctgaactcatggactttagcttctcagcttctgactatggaattgttactaaattatctaacaaagaccttaacaactacttaaatagtctcgtagaaaaatggactgccgatggtagcctacaaagcatctatgatgccaatggtctcaaaccagtcacagaaactgacgaatagaaaggtgaaacaatatgacagttttaacaactagtccttacgcttgggagaattgggtcagttatttcaaagattttccaatctttttccaaggttttctctttaccttagccatttctgtcggagcctttatcatggccatgtttttaggaattgtctttggtagtctctcttcaagtaaaaataaagttttaaaaatcatcgcacgtgtctatgttgaatactatcagaacacgccgcttttggttcagttcatgattgtttattatggacttccactgatttcaaattatgttctcatgccatccatctactggacagctgttatctgcgtcggactctatcacggtgcttatatcgcagaggtcattcgtgcagggattgaggctgtgcctactgggcaaactgaagccgcactttcacaaggatttactcagtctgaaaccatgcgaatcatcattttaccacaggccattccgaccattcttccacctttgaccaaccaagtagtaaacttaattaagaatacggctactgttgccattatctctggagctgatattatgtttatgacaaaatcttggtctgccatgaatgccaactacatcccagcctttgctggtgctgctttcctttacttcatcatgtgcttccccgtcgcaagctggggacgtcgcattgaagaaaagaataagtcagccttttcacactaaaaggaggttgaacgatgaattatgttttagaattactcaaaccttcaaccttccaactcttgtggagcggattgaagttaaccctttatatctcaagcatttcggtaatcctgtccattcttttcggaatgattctcgccatcatgcgcaatgggaaaaatccaattttcaagtggattgcaaccatctatatcgaatttgtgcgtaatgtaccaaacttgctgtggattttcaccgtcttcttagtcttccaaatgaagtcaacgcctgctggtattactgcttttactatttttaccacggcagccatggccgagattatccgtggtggtctcaacgccatcggaccgggccagaccgaagctggtttgtcacagggttttaccccagtgcaaatcatggtctatatcatcatgccacaggccattcgcaagatgctgcccgccatcatctctcagattgtgacggttatcaaggataccagtttcctatactccgttatcgctttgcaagaactcttcggttcgagtcaaatcctcatgggacgctactttgaggcggagcaagtctttgctctctacattatggttgccctgatttacttcagtatcaactttgctatttcaagcctgtcacgttatgtggctaagtcttgggcgagcagtatagaatgaaatttctcccagccaatcggttgggagtttttgctgtcaaaaaagaagccctttcggacttcttgctttatttattcagctgcttcagctggacgtgacttgcgggcaatatctgctaggatatggtccacaaattctgatacagactgagtttgtgttgccttacttccgtagcgacgaacgttgacagcattgtcttccatttccttgtcacccacgatgagttggtatggaatcttgctggtttggctctgacggatcttgtattgcatcttctcgttgcgttcatccacgtgtactcgaacgccacggtcttgcaattctttggcaaccttccaagcgtagtccaagtgagcttccacagagattggaatcatggtcacttgtgttggagccaaccaagttgggaaggcacccttgtaggtttcaatcaagatagcagtgaaacgttccatagtcgagataacaccacggtgaatcataactgggcggtgctcctcaccgtcagcaccgatataggtcaagccaaagcgttctggcaagaggaagtccaactgaatggttgacagggtttcctcgttaccaagggcagttttcacctgaatatccaatttcggaccgtagaaggctgcttcaccctctgcttcaaagtagtccacgcccatttcatccatggcacctttcaacatccgctgggcattttcccacatctcatcgttgtcatagtacttctctttgtcctctgggtcacgataagacaggcggaaacggtagtcgttgaggttgaaatctgcgtacacatcaataatcaactggagagcttttttgaactcttcttggatttgttcaggtgtcacaaagatatgaccgtcgttgagggtcatctcacgtacccgttgcaaaccagtcaatgcaccagatttttcatagcggtgcatcataccaagctcagcgatacgcactggcaactcacggtaagaacgcacatggtttttgtaaacttgaatgtggtgtggacagttcatcggacgaagaacaaactcttcaccgtcgcccatgtccatagttgggaacatatcttctgagtaatgctcccagtgacctgaagtcttatagagttcaacagaagccaatggtggtgtgtaaacgtgctggtaaccagaagccaattccttgtctgtgatgtaacgctccaaggtacgacggatagtcgccccatttggcaaccagaatggcaaaccttgaccaacttcttggctgatcatgaagagatccaattccttaccaagtttacggtggtcacgctctttagcctcttcacgcatttgaaggtaggccttgaggtctttcttgtcaaaccaagctgtaccataaacacgttgcatcattggattttcactcttaccacgccagtaagcaccagccacattgagcaattcaaaaatctggatacgacccgttgacggaacgtgtggaccacgacagaggtcaacgtattcaccctgcgtatagatggtcaaaccgccctcgtcatcagagtgctcgtgaatcaattccaacttgtaaggatcgtttttgaagatttcaagagcttcttccttagtcacttcacgacgttcagaagggaagttttccttgacaatcttcatcatttcttcctgaatgcgtggcaaatcttcatttgaaatctgaccagccgcattgtccgtatcatagtagaaaccgtcctgaatggctggaccaacgcccaacttaatgtctgggaaaaggcgacgagccgcttgggcaaacaaatgagctgctgagtgacgcaagatgtccaaggcatcgtcgtggtcaggcattacaatttcaagcgtgccgtcctcgtcaatggcacgagtagtgtcaatcaatttaccattgaacttaccagcaagagccttttttgccaaagacttgctgatgctctctgcaatttcaaaagtagtcacaccagcctggtactcgcgaacagcaccatctgggaaagtaattttaatcatgtttatctcctttttatttatttttaatccccaataactcttctttttgagctaaaaaggtttccatttctttttgaatatcaatatccaggcggtcggctaattcgatcaaccaccagatattttcagccattttatgctccaaggtataaggcgtttcgtcatagtaacgaccctgcttggtcataatcagtcggttcatgttgccaatatcattggtcaaagccaagaggtcctcatcaatagaccactctttgtcatggtgcttgatttccaactctctataagcacgacgcacatcttgacaccgtcttaataagtcatcaggtagcatcattcctcctccaaaagaaaatacgacgccctcgtaaaaggacgtcgtaacgtggttccaccttcattcgcagtcacgcaaaaaagcctgactacctcagattggcgataagggaaccacccttttatgtttgcataaaatcataccgagtagtgtcaatcctatcctctatgtgcttgcacccaccgcacactctctcaaagatttcctagaattgataagtctctaaaagctattataacaggatttcctgatttttcaaggatttttcctcattttctttcttagagaaaatagcagagctcctatcccatttccaatcagagcacataaggtgtagacaatctgatagagaataatccattccttaaagaaaaagatggttacaggataaagtagtaaaaccaagacaagaaggctaggagaaaaaccgtgaaaaaatccataaagaagaccagttaagaatagcacaatgggagtatagagcaatatatttccgaccaccagttccttagaaagcatagtatcactaatcagatgaaaggcaatcagataaatacctgcatacatggacagaataataagagttgccaaaaccagattcttccaactctctttccgaagcttttccatttgaaacctccaaattattcaaagaaattccggattgattttacttgttcgactgattttttcaatatttttgctgtcgtgtctgttgatttaactactactttttgcggtaggtaaatagcctcttttatcaaagcttctgctacgctatcttgattagtatgttcttttctaaaatcatacgaaatcttcaaatctagataatattcaaaaaccttacgtccaaaattcgtagaagaaatctcatagagcttcttatcaagcacatacggattcattggtggtgtagcaacaattgcctcaacgacggcatctgccaactcctgttctcgaatgaagagcgtcccaaacatcttatctgttataacgttttttaagtagggattgctatgtgccaaaataggagttccagaagctaaactttctaagaaagttagtccctgtgtttcactggtcgaagcagaaataaagaaatccgcagctttataataaagtgctgtatcacttggtgcaatcattcccgtcaactggacatgttcatctagattaagctccgctatcatttcctgaagatcatctgtataaggtccacctccgacaatgaccaacttcacctttggattttccagcaaaatttttggcattgcctgaacgattgcttggatattcttctcgtgagaaatcctagacagacttaacaacatcgtttcatcactagcaattcctagctgttcccgcaactcatctgtttcatccttgccaatttctggtctatcaaactttgccaagtcaattcctgtcggaattactcgtttagaaatcggaacattgtaactcattaaaagatcttcaacgatctcactaggacaaattaccccatccaaatcttttaaaaatgcccgtactaaatatttaaccatcccgggacgaataatcctccccttggcaatatagtgtacgtagtcttcatactgggtgtgataagtatgtaccaccggaatatctagttccttggcaatcattttccccaaaatccccaaagaaaattctgtatgagtatgaataatatctagtttatagcgacttgcaatttttaaggcatctgtaaaacctgcgtaggccactcgacgatctttaaaggcaaaaaaaggtacgctaggaattcggataatgtcccaatcttcgtagcgattcacatcctcatctgtcgtcgtaaaaataaataccgtatgtcccaatttctccaactctgtcttaagagtccgaatcgaagtcgcgactcctgaaacctgtggaaaataggtatccgtaaacaatccaatccgcatttacatctccaatacttgtcgataggcatccaccaattggtgggaaacattgtcaatcgagcgactaaccgcaacctggtagcccgcctcacgtttatcaacctgcttgtctaagattttctgaatagaatcgacaaaatcatccactgtatgtcccaattcggcaacgttttcgtcaatccaaccatcgtaaactggaatatctcttagaacaacatgctgatgactagcaagagcttccagaacaacaatcccttctgtttcctcatacgatgggaagaaaaaggcattcgctccgctcattgcaccttgaaaaacagcacctttaaaataacctggaaactcgacattcgctggatgatctccctcaacaatttttctaatatatgacggaatcagccacttattgattgaaccgagccaaatgaagcggacatgcggcatcttttcggctaccttgacaaagtcttcaattcctttacgtcgaaagtagagtcctgcacagacaacaaccggctgcccttcttcaattttaaaatgctctcgaaagattgcttccttgcgttcatccttcttatatttatctaaatcaataccattcgaaacggctataattggcgttgtcacaccgtaagactggatgagtttttttgaatactctgaaggagtgatgacaaagtctgccttttggtacatgcttgctagatatttccctacaaaaggagctagggtattcgaaccgataaaggaattttgaaaatcttccttcgtggaatgtccatgcatgattaccttttttccactccgtttggctgcatgtagcaataaccaggagcgtggaccataggtattgatatgaatgacatcgtaatctcccagcaggtctgttgtataaggaatgcctgccatatctagcgcttccatctggtgttgaagtgcccggccaattcctgatttctctaaaacagttttaccttctaaatacaatagtactttcataataccattatagcccttttttacattttttcatattttaaactgtattctacacgaattttgtatcaattaaagccaatactaaagaatataatcccaaatatatgattacataaaaaacagataaaacagattttaaaagcagaaggacagcttgaatgttttttagaagatgttataatttacgaatggtgcacattctggcactaagtgttcaaattttattgaggactttagatgtaaaatttgcatgttataacgacacagattagctacataaatcatgctttgagaaaggaaaaaaggataatgaatactaagaaatggagaacatcgctcctaataccaggaatagtattatttggaactgttgctctagtgaataatgtatcggcacaagaagtaaaaaataccatcatcagcgcaaaacaacctgatgggggacaggctacttcaaaggcggttaatgtcaaaataccagcagtagtacgactatttggtcgtgagcttctagaaaatgaatttaaatttgagcttagagaagcgaatggcgaggaactccctgtccttgatacagctcaaaatacaaaagagggtcaagttagatttaaaaatctatcattcgataagcctggcaaatactggtatacaatttcagaagtaaaagatgagcttggtggtattgagtatgattcgaaatatattgtagcaaaaataactgtagaagatcgaaacgggcaattacaggcaatgatcgaatttattgataatgacaatgtctttaacaatttctatacacctgctccagctgctgctagtctttcgataaaaaaagtcctcgagggacgtaccttaaacaccggtgaattcgaatttgttttaaaaaatgaaaaaggcgatgaaatcgaaaaggtaagcaatcaagcagatggttctgtaaactttagtgccctaacatttacaaaagagggaacctatacctacactgtttcagaagttgatggtggacttggcgatattatctatgacaaatcagatattaaggccactgttactgtgaaagataacaatcacggacaactagtctcaacagtgacttatgaaaatagcgatcaaatcttcgagaatattttgaatcctgggaagttaatagcgccaaccacggatagcgttattactgataatgaagtctctaaggaagcaatgaccggtaaagagaagggaaatatcgaaccccctaaagagcaaatagctaatgaagagaaggataatattgaagcctctgaaaaacagatgccaagcattgtgaacgacatggtcgtaacacctgaaaagcaaatgactaataaagagaacgataaggttgtaatctctgaaaaacaaatgccgagtgttgtgaacgaaaatgccgtaacacctgaaaagcaaatgactaataaagagaacgataatattgaaacctctgaaaaacagatgccgagtgttgtgaacgaaaatgccgtaacacctgaaaagcaaatgactaataaagagaaggataatattgaaacctctgaaaaacaaatgccaagcattgtgaacgacatggtcgtaacacctcaagaacaaatggctaataaagagaacgataaggttgtaatctctgaaaaacagatgccaagcattgtgaacgacatggtcgtaacacctcaagaacaaatggctaataaagagaacgataaggttgaaacctctgaaaaacagatgcctgttaatgagaaggacaatgccgtaacacctgaaaagcaaatggctaataaagagaaggaaaatatcgaaacctctaaaaaacagatacctgttaatgagaacaaccaaaatggtacagtcgaagaaaattcaaacactaaaccaacaactgaaaaaacagacaagcaggagacttcaacatttaaaaccgaaactgctaagcaaatcttaccagtaactggtgagaaaggaagtttatggttattgacaagtggtattatcgggcttgcaattgcgttatttacacgtaaacgtaaattataataatcacctaactgatacagttctaaaggatgagaacaagtccagtactgcttctctagattcgcttcaacatctcgcacaacttacagagtgtgacagacttaaaatcaaccacaaagccctcgctaagcttatacatctagcgagggctttatatttattttttataatcttttagttttcggttagtatagccatttcgtttgcttttagtactcgcttcaaaggttctccgaacctttgaaggctggagataagtcgaagcaagtttgcctcaatagctacaggttgctagaacagcctaaaggccgttctaggttggaaatatttcctcgctcgtcaaagtaataaaagataaactaaatgattataatgtttgatagagtgagggggcggagtaataagatatcttatccggctactcccatatttatcacttagttgatttacgtactttgattccgtggttaagaactacctcacggttttccaactcttccttgtgcatgattttggtaagcatgcgcatagcaattgcaccaatatcatatagtggctgattgatagaggtcaggtttggacgggtaaacttagtcactagggaatcatcacttgtgatgatttcaaaatcttccggaaccttgatgcccatatcactgacaccgttcaatagacctgcagcaatctcatcttctgcaacataagctgcagttgctccggcattcaaaatacgttctgctagagcgtagccttcctcgtatttatacttggattcaaaaaccaatccttcgttaaactcgattccgttgtccttcaagccttgtttgtagcctgcaaaacgaactttaccgttgatgtcatctacaagcggccctgatacaaaggcaattttcttgttgttcttagctaatagattgactgcatcaacactagcggcagcgtagtcaatattgacgctaggtaattggtgctccaagtccacggtaccagctaaaacaatcggtgtacgtgagcgtgaaaactccgcacgaatcttgtctgtcaaatgatagcccatgaaaatgattccgtccacctgttttgagaatagggtatttaccacattgatttctttctcatcattttcatcactgtttgctaggacgatattgtatttgtacatatcggcaatatcatcaatacctttggccaaggttgcaaaataagcattagcaatatttggaatcacaacccccacagtggtagtcttcttgctggccaatccacgtgcaacagcattcggacgataatccaagcggtcgatgacttctaatacttttttacgagtattttcctttacgtttttattcccatttaccacgcgcgatactgtcgccatggatacacctgcttcgcgggcaacgtcataaatcgttaccgtatcgtcagtgtttaacatacgttatgtactccctttcaatagttctggttctatgaaaattacgctttcactcaagtatagtgtatcactttttgaaaccactttcaagagataaactctatttttttgataatacttgcaatttttttcattttttgaaacaatagtctatataataaacgaaaatttcactttttttaccactacatgctagaaaggtctccactatgtcaaaattacatcatgttaaatcctacttagaagccaacaaaatggacttggccatcttctctgatccagttagcatctattatctgactggctatcatagtgatcctcatgaacgccacatgatgctctttgttatgcctgaccacgactcactactctttctccctgccttggatgtagagcgtgcggttgcgactgttgattttcctgtagccggctatatggactcagaaaatccatggcagattatcaagagcaaattgccacaaaaatctttctcagcaatctgtgcagaatttgataatttgaatttaacccgctaccatggtcttcagtctatctttagccaaccattttcagacattacacctctgattaatactatgaaattgatcaagtctcgtgatgaaattgaaaaaatgctggttgctggagagtttgcagataaggctatgcaggttggtttcaataacatctcactcgatgtaactgaaactgatattattgctcagattgaatttgaaatgaaaaagcaaggcatctcaaaaatgagctttgagaccatggtcttaacaggtgacaatgccgcaaatccacatggtattccctcaacaaacaaaatcgagaataacgctctgctattgttcgacctaggcgtggaagctttgggctatacgtctgatatgacacggactgtcgctgtcggtaaacccgatcagtttaaaaaagatatttacaacttgactctggaggctcacatggcagctgtcaatatgattaagcctggtgtgactgctggcgagattgactatgccgctcgctctgtgattgaaaaagcaggttatggcgagtacttcaaccaccgactcggtcacggtttgggaatgagtgtccatgaattcccatcgattatggaaggcaatgatttggtcatcgaagaaggtatgtgtttctctgtcgaaccaggtatttacatccctggaaaagttggtgttcgtatcgaggattgtggttacgttaccaaaaatggctttgaagtctttacaaaaacaccaaaagaattactgtattttgaaggataaaaaatagcctcctacaaatctgtaggaggttgtttattctagaaatttctgccgtttttaccgtaaccgtatttttccataaagtcttgacggaattccaaaaggttgtcatccatgattgcttgacggacatttttcatcaaattaatcaagaagtagaggttgtgataacttgtcaaacgaataccaaacgtctcgtcggccttaagtaaatggcggagatacgcacgtgtatagtttttacatgtgtagcaatcgcactctggatctaacggtgtaaagtcctcagcgaactgggcatttttcactacaagacgtccacgattggtcatacaggttccattacgcgcaatacgtgttggtaatacacagtcaaacatatcaaccccacgaattacgccatcaatcaagctatctggtgctccaacacccatgagatagcgtggtttattctccggtaaaagaggggtcgtgaagtccagtacagcattcatttcatcatgtgtttcaccaacagccaatcctccaatagagtatcctggaaaatccatgctaaccaaatcatgggctgattggcgacgaagatcttcaaaaccagcaccttggacaataccaaataaaccttggtcatgcggacggcggtgagccttgagaccacgttctgcccaacgacttgttctttcgatggatttttttacatagtcataaggctggtagaactgcggacactcatcaaagctcatcataatatccgaaccaagattattctgaattgagatagctttttcaggtgacaagaacattttactaccattgagatggtttttgaaggtcacaccttcttctgagatattgcgactatccgccaaagaataaacctggaaaccacctgagtcagtcaaaatcggttgatcccaattcataaatttatgcaaaccacctgcacgcgccaccaattcgtcacctggacgaagccacaaatgataggtattagataggataattcctgaacccatcgctttcaattcttcaggcgacatggtttttaccgttgcctgagttccaactggcataaacatgggggttggaaaggtcccgtgtggggtaatgatttcgcccaaacgtgcacctgtgtgcttttctttcttaatcaagcgatacttgattggaacatctgtcatgttttatttacctcccgctaggaaaaacagtcctaggatattagttctggattcacagttcagctctttcataccatccataaaagcactttacctggaaatacagtttctcaatcttgcatggtctaatctatcagaatgtctttaatgttctcgcttatttcagtgatatttgccttttcttctacttatttaatagtaaatagataggcgcatcacaacaaactgacaaattcccacagcaccttctagtctatcaaaaaaagcctagcttgtcatctagaattatgttacaatgttgggtaaggaggttatgtagatgtttacaatttctaatatacgtgagcgggctcgccaaacgctaaacgagacacctggtatctatcaagtggccgtcatccccgtcactatttctgttatcgttcagttaatttctttctctcgcaatagccttgctggagtgtcggctgaggaacttgctagtccgagctactttatttctacctctttgtttccagtattttacggattgctactaggaatgttgtcattatcagtcatatggactatcttcaatatcatcaaagggggcaaaactaccacatcattcaaagattccttgagcattttcaatcataaagatttctggaaaatctttcgaacttacattttaaaaagtttcttgctcttcctttggggactactgttttaccttggtatcggtctacttatcggtgctggaacgatgattacgattatagctgcatccagtcaatccttagaccctgatgcacttcctatggaaatccttgccatactagggctaatggccatgggaggtatcctacttatggttttaggaattgctctttatattccacaaatctatgcttactcacaggtagaatatatcttgtttgaacaattggaacgcgaagaatatacaggtgccttttcaatcattaaatctagtcgaaagttgatgaaaggttacaagtttaaacgctttacacttgatttatccttcatcggctggttccttcttgtcattattacatttggcctggctggtttatatgtatggccgtatcactatgctgcacaaatgcacttccatgaagaaattttagatgatcaggctaagaaaatgagttacgtataaaataagagcgatatttgctcttatttttatatacgcttttatgtctatatttaagaaaaaaaatatagtaataattggtacaaacatttggattgtgttatactatgactgaggagcgacaaaggactattttagcctgcttggtattggagcagatttcttcctttctattttttacgccatgtgtagtaatttattccaattctaagtgctcctccttagagtcatccggcagttcaatggttcattgagctgctttttcgatgaaaaaagtcggataaatatacccgacttattagtattgttctttcatttcaagatattcaatcttgatacatttattcatgacaatatcgttacgacctgcctgacgcaattgtttttctgcttcttggctttctaaaccgagttgagcccagaaaactttggcgttcgactggataaattcctgtgctacctctggtaaaaattcacttctgcggaaaacatctacaatatcaataggttggtcaatctctgctagactactatagaccaactcgcctaaaatagtcccaccagcagccttgggattaactggaataattttatagcccgcttcctgcatgagcttggaaacgcggtaggctgccgtctcttctcgactagacaaaccgaccactgcaatggtcttagcatttttcagatagtcaaagataatgtcctgactaggattttggaaggaataagacatagagacctcctttaatgtatattaaatgttagaatcaataaaagcttaatgaataaggtgtgctataacacaatcttgtcagttttaactcgttactgattatagcttgtctaccttgattattttttagcaatttggtacacaacatccttaacttggccgataacctttttaagattggtacgctttttatcatctcctggatctaaggaataatagattgaacccacaaccacggagtcatcataagcagctgttgattccatccgataaaaagtcagacgagctaatttttgatctgttaataactgtcgcccaacctgccattcctgaccattgattgtgacaaccgtcttttcactgaaagaatgatttgtttcaaccatccgtgcttctaattcctccggcgtcatattgcgaccgtcttccaatggagactgattaaaagcattgatattatagatttgaaccatgtaattgcttcccccctctttaacatcgtagactgcagcgaccgtctcatccttagtattttctgcattaattgtccaagtagatggcacatcataataacggaaatattccttgatattcccattttcatctttttcagcaacaccattattggccgcataaatcttgtggcctttttgtgtttcgtcggcaggtggtgtactattaacagctacaacctctgcatttgctaaaacattgaactgttcgttcgtagtatcctgtttttcttgcaaaatcggtaaggtggttgaaaactcttcccctgaagaagctggtgttttctcagtcttctgcgatgcttttccgcaacctgcaagtagaagactacatagaccaatacaaagaattaattttttcatactttttcctttcttactttgcttcataccatgttgaaccttcattttcatccgcaatcaatggtacagacaggctaatcgccgattccatagtctcttttaccatggcttttaccgtttctagctctgccactgggacttccaaaacaatctcatcgtgtacttgcaataacatacgtgtcgcaagacctgcttcagtcaaagccttgtcgagattaatcatggctactttgagaatatctgcggccgaaccttgaattggtgagttgatggctgttcgttccgcaaaattacggacattgaaattgcgagagtttatatctggtaattcacgacggcgtttgtaaatcgtctctacataccccttatcacgtgcctcacgaacaatggtttccatgtaattcttaattcctgggaagcgttcaaaataggtatcgatataggctttagcttccttacgtgtaatccccaagttattagataaaccgaaatctgaaataccatagacgacaccgaagtttacagccttggcattccgacggtcatttggtgtcacatactcagctttttcgataccgaagacccgcatagctgtcgaagtgtgaatatctgcaccttgctggaaggcctcaatcaaatgctggtcctgagaaatatgagccaagacgcgcaattcaatctgtgaatagtccgatgccaaaaggacactattttcaagcgatggcacaaatgccttacgaatcaagcgcccttgttctagacgaacaggaatattttgcaagttagggtccgttgaagatagacgacctgtttgtgtcaaatcctgtacatagcgggtatggatcttaccatcttctaaaatggcatcctgcaagccgactacataagttgattgaagcttggtaatctgacggtattccaagatttttgaaacaactggtgcaattggcgctaatcgttctaagacatctactgctgttgaatagcctgtcttggttttcttggtatattccaatggtagtcccatatcttcaaagagaatggtcccaagctgcttaggcgaattgatattaaattcctgaccagctagttcatagatttccttggtcaactggtcaatcaaaacttcgttttcagattgcatagctttgagagtctcagcttccactttaataccagcaatttccatcttagctaaaacatttgctagtggcaactccatgtcaaacaaaagatctaattgctgattttcttctaatttggtcaacatcggctcttctgtctcaatcaaaacctgaaccttacgtgccaagtgtgggaaaaagatctcgcgttctggcaagtctaacttagcacccttgccataaactgcctcatctggaacaagactggtctgaccatagaggttggcaatggttgttagggaattgtcctcaacggtggaaagcaagtatttggctagacggctatcgaaagtagctggaggtagcttaatctcttttcggtcgagaagaacttttccacgcttaaagtcataggtttttatggtttggctttctaaaaagtcacgcaagactggactatcaagtagctcaggccctccgacatagattttctccttatctccccaagctaaaccaaccaaatcctctcggtgataattttcacccaagatttcaaaatagaaaaactggtcttgtttgagcatagcggggctgatttccgttacgatttggaaatcgagcaccgcttcctcttgcgagctggtcgtacctaactgagcccttaattgtttgaagcccatgtcatcataaaattgtcccagttcatccaccttggggccttgataaacaatgtcatccagaccaatttcgattggtgcctgagtatcaatggtagcaagtgtacgagataggaaggccttctccttatcagcaatcaggttttctttcatcttagaagccttcatgctgtcaatgttttcgtagataccatccaaagaaccaaattctgtcaggagttttagacctgttttttcaccgattttggtcacgccaggaatgttatcggacttatctcccatcaaagccttgaggtcaataaactgagtagggctaatccccattttttccatgaggtaggctggggtaaattcttcgaattcggcaacgcctttcttggaaatttcgactacggtgttctcatcagtcagctggatcaaatccttatcaccgctaacaatggtcacatcgaaagggatgtctgtccgctctgccattttgtccaaggtaccgataatatcgtctgcctcatactgatccagttcgtaatgcttgactcccatggcatccaacatctgacggataaaaggaaactgctcacggaattcgtctggagtcttggcacgacctgccttatagtctgcatacatctccgtacggaaagtggtctttccagcatcaaaagccacaagaatgtgggtcggctcaatccgcttcatcatgtggtccagcatgagattgaagccgtaaatggcgttggtatgcagaccgttggcattcttgaagcggtcgatttggttatagagtgcaaagaaggcacggaaggctacagaagagccatcgattaataataatttattttttttcatgtctctattatagcatggatgggggagttttgtggaacttagagagctggaataacagaaaatcccagtcagtgactaggatttttcttttcgataataaatgttctttgcgactactaaactatgtggcttttcaaattcttgatccagataagattggtaggttccgggtgcgataaatccatgcataccaagtatatcggttccagcttgtccaatcacagaatcagccagaagaacgcaattagtagataggacgaaataggttttaaatttagactttctaaatttgaataattccgcatgtattgcctctttcattcgataggcatacatttcaatcggctgcccatctaccgttttcgatactttttcaggacttggattccaaggaagaagcagattatcaatttcagccaatcgagtttctattgcctcttcttgctctggtcttaagctcagctggtaacctaacatggtcattccttcttgattacagaagtcaatataggcttggcgctctgctttgaacaagactccatcaccaatcgcaccacccaaacgctcagacaggacatcgtatgaaccataaccatacactcgtcccttatagctcaaatcaacatgtccaacagccccaaaaccctcttcacctacatgcacaaagacttctaatgctggaagctccgcaatttctttgtggcggttatagatagattgagccgtttgtccctcattatccgccaagtaatcattgactttttgcagggtcatacgaggaatcaaagctgctaaaaataaaggtagaggcaaacggacatggcgcttaagattttgttgctcaatcgcctcctcaaacaagaaaccatcacgcagattagttagtccatacaagatcagataacctccgatgacaattgtttgaacaaccagctgtgtgcctgacacaaatagggaagctgaacctagtaagaataaccaaattccatctattaaatagcgaatccgtggctgtaccccatcttttcgatataggtaaaaagtaatgaaattgataagagctgtaaaaagttgataaatcccaacaaaaatagccgcgaaatagaggggaatttgaacagctaaatcgagactggctaggatcccgaaaagaacagccttcccaactagcgcaataacactttcacttgatttcttctttctgaaaaatgtcatgctcaattcatataaagctaaaaagaatagacctgcgtgaacaaatcgaagaatcagtcctggaaattgccaaccagcaattaaaaatccaataccgatgaagactaagattagaccttctccaactaattttcgacctgttaatcctaaatcacttatttttttcatgagatgattatagcacacttctagacttgtgtttacagaaaaatcctagatgcactaggatttttttgctttatagctgtgtttctcatatttcaaattagttcacaatacagactatccgctttcgtgtttttaggctcgggttaaaacagtctattcccagactgttttaatcaaccgacttcaaggccaccagcatatcaacctttctcagatggtgattgacataccaaccaagaacagacaaaattccactaatggctaagataggaatgagatagacttctagtccgacagatggattgaagcggatactgtccgaaccaatcatggcaagaaggagcttgtggagataaataccgccaaccagtccaaccaacataccaatcagcgaaagggcaatggtttcacgatagatgtacatggtcacctctctattgtggaagcccagcaccttgatggtggataattcacgaatccgttcggacatattgataattgtaaggttgtaaagaataaccaagccgagcaagatggataggatgactagaatggtcatgatggtctgaagcgagcctgcaatcgtggtaagcatgtctataagagaagtattttgaaccaaacttctgactgctggcatcgctaggagttgacttgcaagagtctgaatatgccccaactgactgtctttcaattgaaccaaataggcattggcagtcttctgcttgccggtcacttgttcgtagtagctatctgtcatgtagataaaatgccctgcgtacatatcagccacagcctctaccctgactgaaacttccttatcttccaaggtcagtgataacttatcaccaactgagaccccgtaaatttgcgccaatttttctgtgaggacaatccccctgtcactcagtttaataggctgacctgtcgagctttccagactgacttgatttccaaaatcccgacggtctgaaatgtagagactaatcgataaattctttctctgaccgttttcttccaccgtttgattgagctgttcaaaagccactggcaaggattggcgaacctgatctgactgaagaaaatgtgttaacttatctaactcttcctcagtagctctgctattttccaccaccaacatatcataatggatcagctccccaaactgtcgttggacaactcctgagatggaggaacggatacccagtcctccaaaaagaagggcgacggtccctgctactccaaagatggtcataagcatacgaagcttgtagcggaagatattgcgggctgtcaccttatgggtaaagctcagacgagaccagatagccggccatttttcaagccaaatgctggagcctgtgaccggtggcttaggtaaaagtagctgagcaggtttttctgtcagctcccgacgagccaccaagtaagctggcaggaccgaggaaaccaaagataggagcaaggctaaacctgtccaaaggggataaaaatgaagtttagctggtccaatcacagttgtctgcgtaataatgtcggaaataagtggagacaagaggagattacctgctattatgccgactattgttcctaccagacctgccgccaaaccatagagaatgaacttagccataatctgtctattcgtataaccaagggccttgaggatacctgactgtgttcgctcttcatcgacaaaacgggccatggtggtaaaagtcactagagctgcgacaaggtagagaacaactgggaagacattgcccactgcagcaatagacctagtcgcattgctataggtagtatagccatctccacctggtaggcttgaacgagtatagacctgatagggcgcttttgccagcttacttaagtcggatttagcctgagcaatctcggtttgagcttggctaatttcttgatcggccacagctttcttatcagaaaattgggattgagcttgacttaactctttatcagcctcctccaaacggagttcttcctgacggagcagttgatttgaagactctaactgactcagtccccattcatagtcttctactcctttattgtaggctgcaatgccttgttcatactgactcaaacctgcttgataacgggccaaacctgcctgatattcttgattccaagtttggtactgggctagattgctattgtattcattttgtttggtttgatagtaatcataaccttgtaaataggcttggttggcctgctcatgtgcagattccatttggtctaatcggcttttctcaacatccaaaccttcctgtctggccaacaagtcaggatagtctgagagggtttgaccttcttgcaagtgattggcaatttcaaggtctaactcttgctgagcttgaaaccaactagctcgccctgtggaaatctgagatgcggtctgactcagttgggcattttgggaatccaattcttgcttggcctcttctaactgctgggctgacatttctaattccatctgatagccgtctagaaatgaagcagtctgttctaattgagccttacgcccgtccaattcctttttactttcttccaattcaaacttattttttaatagttgggcttgggcagctcgtaattcagcttccgtttggacaaccttagccctaccacgcgcaaactcactgcgacctgtcgctaattgctcctcccctgtttccagttctgactctgcctgttcaagctgggactgagcctgagcaatttcctcttccccttttgaaatatctgtctgtccatctgactgaatagttgccaatcgttgttcatcattgttagccaataacttttctaagtcttcttggtgctggtccaacctgtcttgataggcctgactgtaatatggtaaatcaaccaaatcatcatagcgaatacgggcaatagtgtaaacttctgatttgaaggtatcctgactaacaaggccatagccacctaactgcccatcaccacttacagccatgcccatggtttcattgtcccaaatttctgctgatgcgacaaagcccacaagagtaaaacttgtctgtgtcaagatttttccatccttatcagactccgtcacttgaacagtatcgtccaatttgtaacgatttttgaaagaagctgatagggctatttgccccttttggctgggcacttccccttctactagtttataggtcgatagggtcttgggagctgaaaacagccgaattgcagtctgaccttcattagtaaccacatctttaaagtagcccgcttcaagagtagcaccttctatcgtttctaattcgtcaaggtcagcttgactaagtcccagacctgaaattactgccaaatccatcgttcgatgactggctatgtaggcttgggccgtcttttccatattgggagctgttactttcagacctgtcaaagctagagctcctagcatcatcaggctaaatatggacaaaaaacgccccttggaagaaagcagagattgtctcatatccttccagtagattttctttttcatagtttcacccactaatattctaggcttgcaatatcctgtggttctgcgtgtaactcaacggagtgcacacgggcatcccgcatccgaatgaccctgtctgcaataggggctagggaactattgtgggtcacgataatcaccgttgccccctgcttgcgggacatatcttgtaggatttgtaaaacctgcttacctgtttggtagtccagagcgccagttggttcatcgcaaagcaaaattttaggctttttggcaacagcacgggcaatggccacacgttgttgttcaccgcctgaaagctgagcagggaaattattgattcggtgaccgagtccgacctgttccaagacctcctcggcatccaaggcatccttgacgatttctgctgccagttccacattttccttggcggtcagattggcaaccaagttataaaattgaaatacaaaacctacatcatctctacgataattggtcagttcatgacttgacagcttggcgatatccacaccgtcaatccaaacctccccctcgtcgttgctgtccatgccacctaagatattgagcagagtggatttgcccgcaccagatgaacccagaatgatgaccagctcaccctgctcaatctcaaaggacacaccatcattggccacaatggtcgcatctcccatttggtagtattttgacgaattctttacttggatataggacatgatacacctcgcttcttctcttcctaaaaactgtattcttactacttattatagcacaaaagagggttttcaccctctccttcatcttttacacttgggcaatagcagagccgccatagagtttgagttcttctctgatcgtttcgtagtaatatcggtcaaatgcccgccaagcctgcctgctggtttcactcaatcgcaggtcgcccagtccaaccaaaaaactggtcgaacgataaaatttctcaatcgcaatcagttctgtattggtaaccgacttggcctccgacaatatgcgtgtcgtctctgtcagattatgttggaaccgttgttcatcagctgttcctactttatctgcttgaaaggcccgattcaagtcttgaatgagggccaaaacgtcttgaataatctgtgtcttttccataaaagaccctccttgtttttgataaatttagtatatcaaattagacaaaaatattccatcaaaaaacgatgcctgttccggcaccgttatatctttatttaacagcctccaaagccgcatcatagtctggatgttcgttgacattatccaagtattctacgtaggtgatttcattgtcggcattgaggacaaagaccgcacgcgccagcaaattccactcccgcatgagcacaccgtaggatttaccaaaggcatggtcatagtaatcagacagggtgatggcatcttccaaacctgcagcgccacaccagcgtttttgggcaaaggggaggtctgctgaaaccgtaataacaaccgtattgtcacggtcagccagttcctgattgaagcgacgggtctgggtatcacaaatccctgtatcaatagaaggcacaacactgatgaccttggtctgcttgccaaagtctttcaggcttttcaagctcaagtcattggccatgaggacaaaatcaggggctacatcccccactcttaattgcggacctaccaaggtcaccggttttccaataaaggttgtcataaacatctcccttgcacttaatatatacattgtaagcgtttatgtaaaaaaataccagttttttgactggtatttttgatatagtttgtaggttttcaatcgcagagcgttcaagacgacggacactgagctgagggccatggctgcacctgcaaacataggattgagcaggggtccaccaaatgcatgtaacagacccatggcgattggaatacctatcacattataagcaaaggcccagaagagattttgtttgatggtccgcatggttgcctggctgagtttgacagccttgaccacatccaaaatgtcactatgcatgaggacaatgtcggcagactcaatggcaatatcagtccctgaaccaatggctagacccacatgtgcttgagctagagctggggcatcgttgatgccatcccccaccatagcgactgtcttgccctgttcttgtaagaacttgacttggttagccttgtcatctggtaggacctgactgatcacctgttcaatgccgacttccttggcaatggctttggcagttttttcattatctcctgtcagcatgacaacctctagtcctatggtttgcagagcctggacagcctgacggctggtctcttttattttatcagcaatggcaatgactgctagtacttcttgctggctggctaggaaaacaggcgtcttggcttgctgggcaaatgcctccgcaactgcacgtcctttggaaacatcaattccctgttcccgcatcaaccgttcatttcccagatagatggtctgctctgctattatcaccgaaagaccacgaccagaaagtgcctgaaaatctgtggcgggcaagagttcaatcttttctgtctgagctgcttgcaggagagcctgagccaagggatgttcggaaaattgttcgctacttgctgctagctggagaacttgctcacgatttttagtagacaagaggtggatgtctgtcacctggggtttgccctcagtaatggtcccagtcttgtcaaagacaatggtattcacaccttgtagggtttcaatagcttgaccagacttgaacagaaggccattttctgcaccttttccagtaccaaccatgatggcagtcggcgttgctaagcccagagcacaagggcaggcgatgaccaagacggcgatgataatacttagtgaaaaaatccatgattcttgacccaagaagtaccaggccagacccgacaagagagccaagcccatgacgactggtacaaatattgcagatacttggtcagccaatttggcgatgggggccttagaaccttgagcctcttctaccaagcgaataatctgggccagagtcgtatcacgaccaaccttggtagcctgcatggtaatggcgccttgctggttaagggtgccgccaaaaacattattgcctagagctttcttcactggtaggctctcacccgtcagcatagactcatccacacgtgtctggccttcgagaacctgaccatcaacaggaatctgttgcccaggacgaacaataacctggtcaccgaccaccacttcttcaatcggcacttgcatttcctgaccatttcgcaagacctgagccgccttgggggccagatccatcaatttcttaatcgcctcagaagtctgacctttggctctagcttcaaaatattttcctagggtaatcaatgtcaagataacggcggctgattcaaaatacagttctggatggtgaccgtgcatggccacttctttccccatctgaagaaacacaatcatcaaaagaccttgaaccaaggctgcccctgtcccaacagcaatcaaggaatccatattgggatggccttgcaagagagttttaaagcctttttggaaaaaactgcgtccgatatagaggatagggatgagcaagataacttggctgatcgcatagactagcggttggtggagcaaagctggtaacggaagccctccccaaggcaacataggacccatagcaatatagagcagtggaaaagtaaatgctgctgaccagacaaatcgatgcctcagcttttcttccgtgctcggtcccttgtccgcagccccttctactttttctggtctaatcaactgataacctgcctgctcaactgctctttcaagactagctggattttgcctatgacggctataacggatagtcgccttttctgttgctagattgacactgacttcttctacaccctctagtttgcccagagctttttcaaccgtcagagcacaggaagcacaggtcatgcctgaaatgtcataagactcggtcaccaagttatcgactagctggtaccccgccttttcaactgcctgacgaatatcctctagtcccaaaagcttttcatcatagctgacactcaatttttcagtcgctaggttgacactgacttcttccattcctgctagtttaccaaccgctttctcaaccgtcagagcacaggaagcgcaggtcataccttgaatgggatagcttgcttgtttcataggttactccttttccgactacatctgtaaacaaattatacaatatacgactacgtttgtaaacatttttgattaatactcttcgaaaatcaaaatcagacgttgttgacttgatttgatgactgaaaagctcctgtggaggttttcagcctgttcccttgaaatataaaaggaacagtgttctatctacatcatatcgatacgaactaggttcgctctatctccaacctccaaaggttccccaaacctttggagcaagtctgtttttgattttcattgagtataaaaaatagattggagagaccccaacctatttcttactagctctatttattctttactggatttttttcgatgaagaaaaattgctgttaaaattcctgcaacacctagcgccaccaacaagaggctgacttgctcacctgtactaggaagacttgatttaccttttttattggtaggtgttactttcttatcagaaggcactactgttcggcttgatgaggaagtatccgtagctcctcctgtgttagaatcacttgtagactgacttgtactggttgaagtttcggtaccacttgatgatggctcagtgctggtcgatggttcagtactacttgatgacggagttgttgctgcttcaatttttgccatcatttcagcttcaacagcttttagttgggcaaaaatctctgctgaacgagccaaggttgcctctgttacagttggagccagagctacggctgcatcttctgaaagtccggcatattgagcatcaagagctgcctgtgaagcaatccattctttttcaagtgcaatccatttttcttgaattgatgtaccaaataactctgggtgtgagatggccatcttatcaatattttgtaccgtccagtaccatgaattggtatcataagaagctgagcgatttttaaaggcttcataagtatcagtcacaataccataaaatggaacatacggtgtattccttgtctgagccaagcccaaccatactgtgccaccgaaggctgatggtaagctactattaatctgataaacatgggcatcgatgacgttttcattaccaagagcgtatttataagtcgcatctgccgcttggtcattcgcaccattatccccttgttttaccttacctgcttcatcgtctggacgaaattctggaagatgttcaaaacggttacgttgtaaggcaaaggtatcttgtaaactaaagcgacgacttgggtctgttggctgacgtagcaaatcatacacagcatcttcataggttacagacgatgctggatctaacaattttataccagcgtatgtccgagaacgatcaccatcagcataattctcaggtccatatgatttggcaatatggaacttcccatcaaccatcatataattttcagcctgtttggctacttcttcaacctttgcagaagcaatcacattttctgtatcggtaaaatcaacatgacctagatagtaagtatttgcaaaaattgcatacttgtcttctgggaatttgatggctacgtattggtgacctgacaaaatttccatgtaccaaacttcattcttatcagcaataacaatgatattcccttctgccgaacctttttcatcaattgtcttcgcaattaattcgataccttcacgcgcactggtgactctaggaagaacatagtcaatcaaaatggcctcacctagtccccccgcagttaccaatgggtcaacagctaaaacttttttatttggaatagctgtaacagtagcagtcatggacacacctttttcattaaatccatgcgcaccaaaattaccgtttgacccatccccacgtgccgcatcaggcgtagaggtgtacttgaactcatttgccaagtgtggtgctgtgaaaccgaatgattcatccaccaacatatcccccttggcataggctgttgctggaaccacaatataatttttattgtgcgctccattatttggtggatatggataatcttccgttctaccataaaggatagaaccatccgttgtcaaccctttcccaataataaagcctgaacaggcttgaacaagttgaacagggaataggcaaaccaacattagaaatgtggctatacgaacaaaagtctttttcatagacttctcctttcctgatactctgtgaaaatcagaagtaggcgccctccagagatataaactcagagactattttacacaagtctcttatccaaccagaaggtgattttcgtggagtataatatgatttacccatttgcacctacattgtaacgcaaaagcacctgccttgcaagtgctttcaaaaaaatatttatccttttttcctagccagcatggtcgcaaaccgcatcttgaggaaatggccattttcatcccgcttgtgaagttgaccgaaatcttcattgtacttgaccagttcccagtcacggtagtattccttcaactcacctactccaaaagtaaaggagaaattcataggacagggcgcatcttctgtatccatggccgccacaatcaagttatagccaccaggtcgtgtctgctcctgcatattgcggataatagctggcacccgctcccgctccaagaacataaagacaacggttgagataatccagtcgtaatcctgctccagactagctgagttaatatcgtaagtcccagcctgcaagtccaaatcttctacttccttgacctgcaagagtgtccgaatacttggtacatctttatctacagcagttacctcaaacccctgctgggccaagtagagactgttcctgccatgaccacagcccaagtccaagaccttacaaggctcaattctcttcaaggcctccaagacttccgaatgtgtccgagtatagtcatactttttggcaaaatagtcttctggttgacagaaaaattccaagaaaaactccgtatcctctgtcagcaaagtcacccgatgccaagcctgtggctcgacaaagggaacatcatctgtcggaccatagacaaattctcccaaaatttcattatcatctgaaatcggctcaaatttaagttgacctctcaagaccttgattttggcccaagtacctaccttggtattgtgcttggtcaaaaaatgctggggaaccgtatcctgattccaaataggcatgcgtttgtaaggaactaaaacagtcattatctctccttttcgtctacaaaacttaaaacgtgtttctagtctatcacaaagaaatcttgatttcaaatctatattttcacttgacttagagtgaactccaaggtgtataatattccatatcaatcagaaaggacatttattaataaatgtaggtgtgtagaaaatatgaaagcagctatttatgaaaaagccggtaagatgaccgttgcagaaatcgaaaaaccaagccttcaagccaaagatgacgtcattatcaaggtcgttcgggcctgtgtctgtgggtcggacctttggggctacggagaagacattcaccatgaccacggtgacacaaactctggtcatgaagccatcggtatcgttgaagaggtaggcgaagacattacaacacttgttcctggtgacttcgttatcgttccatttacacatggttgcggacactgtgatgcctgtcgtgctggctttgacggtacttgtgacaaccatccaggctacaccaactggggcaacaactaccagtctcaatatattcgtttccactacggtaactgggccttggtcaaaattcctggtcagccaagcgactactcagaaggcatgatcaaatctctcttgactctggcagatgttatgccaacaggctaccatgctacgcgtgttgcagatgtcaaacctggtgataaggtggttgtcatcggtgatggtgcagtggggcaatgtgccgtcattgctgcaaaaatgcggggagcttcgcagattatcatgatgagccgtcatgctgaccgtcagcaaatggctctggaatcaggggctactgctgttgttgctgaacggggcgaggaaggaattgccaaagtccgtgaaattcttggaggtggcgctgatgctgccctcgaatgtgtcggaacagaagcttctattgaccaagccctcggcgtccttcataatggcggtcgcatcggttttgttggtgtgcctcattacaacaaccacgccctcggatcaacttttgctcaaaatatcattatcggtggtggctctgcttctgtcacaacctatgataaggaaattttgcttgatgctgttctcaaaggcgacatcaacccaggtcgagttttcacccaaacttacagcctggacaatatcgaccaagcctacaaagacatggccaaccggaaaacgattaaagctatgattacggtggattaagataaataataagccccagatagtctcgaaactgtctggggtatttgttttcctataacaaaaaagaccgggatttctcccagcctctatcgactattgatagccttcatggttcgtttgatatcacggtcttgctcacggcgtttaattgactcccgcttgtcgtagtcgtgcttccctttggcaagcccaatcaaaaccttggcaaagccatccttgatatagaccttgaggggcaccagagtcatccctgttcccttgacctcattgtccaaagactcgatttgcttcttccgcaagaggagcttgcgggtccgtgttggctcctgattccagatattgccctcatcgtagggagcgatatggacattgaccaaccaagcctcgccctgcttgatctgggcaaagccgtccttaaggttgatccgccccgcacgaatagacttaatctccgtccccgtcaggaccatccccgcctccactgtatcgacaatggtatagtcgtggcgggcttttttattttgcgcaatcacattgccctcacccttggccatgcctatctccttttcttcttgttctttttagccacttctttgtaaaatggtttctttttcttgtcttttttgccactttttgacttgtggtcttttccagacttgtgacgtccgctgtcgcgaccagcagcttcttgtttgtagtgcttgccccgtcctcgccctgaccgatcatcacggtcacggttggagtgactagcagttctccgcttggctttcaaagctttttcgacaatatccagttcggacggcatgtgggcaaaatcgatttcccctgtcatcttgtccgcccgcgttagcttgatacggattggctgaccgacacggaagacacgacctgatttctcaccctgcaaggtcagagttcgctcgtggaactggtagtactcgttgaggttggtaacatggatcagtccttcaacggtgtttggcaactcaacaaagagaccaaacttgactacgctagatacgacaccatcaaactcttgcccaacaaattcttgcatgaattctgccttcttcatagcttcaacttcccgctctgcatcgatggcacggcgttctagactggatgaagacttggcaagctcaggaatgacctgctcaaaatgctctgctttttccgaaggattgtgaccatattcccgcaccatacggtgaaccagcaggtcgggataacggcggataggactggtgaagtgggtgtagaactccgcacccagtccgtaatggccgtggttgtgctctgagtaacgcgcctgttgcatggaacgtagcaacatcatgttgaggacgtccgcatagggttcatccttgacccgctccatgagatcctgaagggcgtcctggctgatagagctggctgtaccatataccgtcagaccaaagctagtcgcatagtcgatgaacttctgcaacttgtctgatttaggctcctcgtggatccgatagataaaaggcaagtccaacttagcaaaatgctcggcaacgcactcgttggcagctagcatgaaggactcaatcatccgctcggcaatgcctcgctggcgcagttgaatatcgactggcagaccatccttgttgacgatgattttagcttcagctgtatcaaagttgagagccccacgcttgtagcgcatggtttccagggtttcatggagtttgaccatgagctcaacacttggcacgattgtcttgtatttgtccagcttttccttgttacctgcaatcatgtcattgacatcggaataggtcatacggaaggtggttttgataaccgtttggccaatccagtgcttgaccaccttgcccttgcagtcaatttccataatagccgactgggtcaggcgatccacatttggattgagggaacaaatgccgtttgacaaacgttctggcagcattggcaccacacggtcggtcacatagacagaggttccccgcttgacagcttcctggtccaaggctgagccctcagtcacatagtagctgacatcagcgatatggacacccagttccagattgccattcttgagctgcttgatatggaccgcatcatccaagtccttggcatctgcaccgtcgatagtaaagatgatctcatctcgcaggtccaagcgtccttcaaagtccttctcagacggactttctggtacccgattggcctccgccaaaacttcgtcagggaattccgacacgatatccatggattccaaaacttccaagacatcgatccctacatcatccttatgccccaccacgtcccgaatggtcgcaacaaagtggtcccgtttcttgtttggataggcttcaatgtcaactttgaggatttccgttccggtcaataccagaggtgacttcttaatgtaaatcttctgagcgattttctggtttttagacttgatgtagcctgcatactctggcttgtcttcgtcaaagacaatcaagcccaccgctgttttcaggctatgttccaaaatatcaatgacttccgcttccgcagccgtccccttgaacctgtccgccactttcttgatagccacttccactcggtcgccctcgatagcgaagttgacatcgtcacggctgacaaagagatcatcttcctcttcatcaatggtcacaaagccaaaacctgacttgtgagcacggaaaatcccctgtaaggttaccttgttcttagagatttttggagcaggaagagtaatccgcccagcattatcaaagacaagttgacgactgccttccatgctagaaaccagcttgaccaagtctgtaaagctcttagcagaactggctccaaactgatctgccagctggtccatggtcacaggaccaacttctttaatatagtttataatttcgtttttcatcttgtatttaccagagtgctagttaagaatctagcactatttctctttcagtcctttagtttatcttttattactgcgacgtacgaggaaactccgtttccctatttccaacttcaaataatttcatcattatttgaactcgctttgtcgtacttcagtacagtctgcagctcgttgcctagtactaaaagcaaactaaaagactgtattttgcgttatatccagacgcagtggttgattgctccaacaatcaaatgattgttggaggtgggagataggatttgcaaagcaaatctcaatagttcgcgaataacgctccgaaccatacctattcaacttatgcggaggtgggcagacgaactctttatacttgtcgagttctggcccactcccaaaaaaatagaccaagaacaagtcccagtctgatttatctacttacttgaaatgataacaagtgccagcgcatccaacatccataggaaaatcagaatagccgtaatacgttgcatcaccgcttcaaaaccacgggcctttgtacgttcaaataaggctccactagaagagtcaaagacgttgctagactggttttttgctggctgaataaaaatcactacaatcaaaataacagataaaatcaacagaattgctaataatgcttgatacatatttttttcactttctacaataacttatgacattataccataaaacctacttagtttcaaggtggagggttacttttctctcttttgggcagtatttaaggacttcaatcttatctggatgagtcttggcgtttttgctagtcaagtagttcttactaccacattctgaacattgtaaattgattttaactctcactaaacatcccttactttcaaatagtttctaaaattggtcaaagaccagataaggttaaagaggacaagtccgctcgacagatagaaaacccagtcataacccatgtgagcagctaccgcagaccccatcatgggaccaacaacagaacctagattattaaagagttggttgtaggaaaatatccttgaaattccttcttttggtgtcaacttggtcaaaagagaattgaccgaaggcaacagtgctcctgtcccaaaaccatacatgaatcgcaacaaaccaagctggaaaggattttctgcaaaaacacagaaaacattaatcaacagactgtaagtcaaagcaattaatagaagtcgatggttgccaatacgatcaccaattttccctaaataaccggatgtcactagcgatgccataccaggcaaggaaatgataaaaccagcaacaaataacagattatctgtctgtcccaaatgccgcacatagagggtcaatataggaacaacagcctgagcagctgcaataataatcatagaagtcacaaaaagcccaaccagcatctgccgatctttcacctgctcaaatacctctttaaccgacatctcttcgccttttttgactggaacaaaatcctctcgaatatagaaaacggtcagtaacacaacgatagcataaagaagtcccaccagcaaaaataccatatgtacgccaaacatctctgctaagataccacctagggtcggaccaatcaaattacctgctaccgcacctgttgataaggtccccagagcataccccgtcttatcctttggaacctgactggcaatcaaggcagtcgcattgggaatgtaccctgtaaataccccgtttaggacacgtaaggtaagcaaccaaaaaacatttggtacaaaggccataccacccatagtaaaaatcatggcaaaggccgctcgcaccatcatgggcttgcgaccgtaacggtccgccaaactcccccaaataggtgccatcaaggctgccgcaagggcattaacagataccgcaagccccgcataatattctacctgtccaggacctacccccaactcttccacaaaaactgagataaaaggcataaccaaggtaaaactcgtccctgttaggaaatttcccaaccaagccaccttcaaattctgcttccaataactactaccgtcgtccatcctttaattcctccaaaagctgagcaacctgtgctaaggtcgcctcaaccgctccgctattgtcaatcaccacctgggcttgcgaccgtttttcctctaaagaaagctgagcagccagacgattttctgcatcttgaacagctaagccattacgtttcataagccgttccaactgctgtgctctatcgacataaactagccagatttcatttacttccccgctataatctgcctcgtaaagcaaaggaatatccatgaaaagaacttgctccgtctgttttagagcatcccttctgtctaacagctcctgcctgataatttggtcctgcaggtcagacaggcgagcccgcaacttgctatccgcaaaaacagcctgacccagcttgaccctgtctaaatgtccatctgccgacaagatgtctggaccaaactctttcagcaaaatctgatagagcttgccacctttggcctgtaattcgtgaacaaccgcatccgcatcaatgactggataaccttgttctctcagaaaagctgtaactgttgattttccagaggcgattccgcctgttaaaccgataattttagccatgtttcacctgacacttgggacagaaatgtgtcccccgtccgcccagctggattttgacaatctctgtctggcaacggggacaggcctgccctgtctttccgtaaacttgtaaataatcctgcatagtcccatccatgcccaaggcatttttgtaagtccgaatggttgaaccacctttttcaatacccagttgcaggacttcaatggtggcttgacggaggtctgccacctgatctgtcgacagctgattactcgtttgtgcaggatgaactttggccttgaacaagacctcatcgacataaatattgcccaaaccagccaccaaagactggtccaaaagatgcgacttaatgggctttttcgacttagctaactttttggcaaattcttctaagtcaaaatcttcctccgtcggctcaggaccaatttttcgactgataaaataggcatccacatctgccttacccagcagttccatggtcccaaacttgcggacatcttgatagaccaaggtcgagccatctataaaagtaaaaaaggcatggaaatgtttgttggcaggcacctggtcagcaaagaaattgtacttaccttccatccgcaaatgagaaatgaggacatggtctgtcaggtaaatcaagagatacttgccacgacggtccacatctaaaatctcctgaccaatcaagtcttggcagaaggcatccacacctgtcttaatcatgggagcataggtcacctccaccttggaaataacttttcccttgaccaaacgattcaaaccacgacgaaccgtctcaacctcaggcaattcgggcaatttacgataccaagagcgtaaaaagcgactgaaaattaggagagcgacgctgtgtgacttgcacacaaggagctctatctattttccgagcttttagctcgggttcaagtacgcaaacactcatcctttctaacaaaattacaaagcaaatagaaacctgaccgacggtgcttcggcacctaggtcacggttgtgattttcaaagagtcgtaggcgagttcaagacaacgcctaatcggctttcctttcttgtttactaaaaagatttctccataacgcagtaaaagcctttcggcttttctgctaactatttctaagtgattgacttagacagcctatccccaggctatctcgccttccaatttctaagatcgggttttcaaatggtcactttcacattcctatgtgacctgctgaaacagtctattcctagattgtttcactcccccgaactacctcgccctctagttttcaagctcggttttttcaaatggccactttaacatttctatgtgaccagctgaaacagtctattcacagactgtttcactccctcgaacttcctcgctctctagtttccaagctcgggttaaaaacgtcccccggacgtttttaatactctttctcattataaccaaagtcggcgaggtcgagttttttgtctcgccagtttttcttgaccttgacccaggtttcgaggaagaccttgtcacctagcatgagttcaatatcacgacgagccatggagccgattttcttgagcatggctccttgcttaccgatgatgatgcctttctggctatcacgctctaccataatcgtagcgcgaatgtggaccttgtcggtaaattcatcacgtttcatggactcgatgacaacggccacagagtgcggaatttcctcacgagtcaggtgtagaaccttctcccgaatcatctcagataccaagaaacgttctgggtggtcagtgatttggtccgccgggaaatactggaagccttcgtccaggttttccttgagaatttccatgagtcggttgacattgttcccttgggtagcagaaattggcacaatttccttgaagtccatctgttgacggaaatcatcaatctgttccaaaagctggtctgggtggaccttgtcaattttgttaaccactaaaatgactggaaccttggcctgtttaaggcgttccataatcatgtcgtcacccttgcctcgcttttcatcggctggcaccataaagaggaccgtatccacttcacgaagggtgctataggcagattccaccataaagtcacccaaggctgtcttaggcttgtggattcctggtgtgtcaatgaagacaatctgctcttcttctgtcgtataaatgcccataatcttgttacgggtggtttgagccttgtcgctcatgatggcaattttctgccccattacatagttgagaaatgttgatttcccaacatttggacgacctaaaatcgccacaaaacctgacttaaatgtcatgtattctccttatattctaaaaaataaagtcccaaattttcggcacaaagataatcaatcctgtcaacaaggcaaatcctgacacaaacaagactgcccctgctgccatatcttttgcattctttgccaacatagaaaaatgatagtctgacgccaaatccaccacattctcaatagccgaattcacaatttcaaaagcgataactagactaatactgagcaagaggaagagccattctgtcacagatacttggaaaataagtcccgcaagcacaacaaggacagctgaagccaggtgcttcttcatattgcgttcttccttgaaagctgtcaacaaacctgttactgcaaattctagactagcaatcaattctcggtttttccagcgattttttgaattattctcttgtaagtccataggccgtcaaaatttcttcttgtaaaccaaacatttctgcttcttcttctggcgtataatgatcatagccattgatatgcagaaaaccgtgtacagctaaaaagcccatttcgcgctcgtagctatgaccataatcttcagcttgctcacgtgccttatcgatagaaatatacaattcaccaatataggcatcgaaatcttccatcatttcagccaattcaggattgtccagtaagtcttcctcatcaaaaacaatctccgactctggcttatattctaaactgacaacatctgtcggacggtcaattcctcggtactccaagttaacctcatggacacgcttattgtccacaaaggtcacagccatttccttattctgcttgccaattttttcggcagcaaactggagcaattccgtaatctgctcctgcatttgagcagaaacctgccctgtttcatcaatcatttcaatatacataatcttacattccttttacgtttccattatatcataaaacctatcaatgagggttttttagtggtataatgtcctcagaagctatcagaggaatggaaaatgttacaaacaccgaaacacattactgccatcattgagtctcatctggatcagatgactagacttgaaaagcagattgccagttattttactcagttagacccatctagcgccgatcttagccaagaaaacactatacagcaactccacatttctccatctgctcttacccgttttgccaaaaaatgtggattttccggttatcgagaatttgtctttgcctttcagaataaccaacaatacttggataaacattttgaaaaattacagcggagcctaacaaaaaaagtcttggtagactatgaggaaatcctaactgctaccaataaactggtagatgaggaaaaattagaagagattgccaaactgattgacagtagcaagcgtgtctatttttacggaatcggcagttctggtttggttgcaatggaaatcaaatcccgctttatgcgactgggtgtagtctgtgatgcaattactgatgaaaacaatctcatctggactaccaatattctggatgatagttgcctggttatcggtctttctctgtctggtcagacagaagaggtcatggagcatctccagctggctgctcaaaaggggattcctaccgccctgttaacaactaggagttttccccatccgacttttgaccaaatcattcctgtcgcctctgtccgccacctcaattacggcaatcgtatctcaccccaaatccccctgctcatcatgctagatattatctacgcctattttttagctattgacaaggagaaaaaagagaatattttcaagcaaaccattagagaataattcatccgtctttctatttcacaacaatcttaataaaacaaaaagcattcaaaaatacccgataggtacagtttgaatgcttttaattcgcttaaatataactctattcttcaagaccaagaatttgattgatttcttggctatacagaatagccttacctccgaaaatagcctgtattcctccttttacatccaaaacagccgttgcacctatagactgaataactcccttatccacaagaccactatttctgagcgatactcttaatcgagtcgcacaggcagtcacattctcaatattatctgctccaccaagagcatcgatgatagcaattgcattatcacgaagactagaaccgtttgataaaactttttccgaatgtgatgcttggtcactgctttccataccaggaactagcacgtgaaatttggttactaaaaatttgaaaactagataataaactgctgcccaaagcaagccaacaggaatcacgtaaatccaattggttttgtcatttccttggaaaacaccaaaaatcaagtaatcaataagcccaccagaaaatgagttcccaatacgaatttgcaggagatctgcgactaagaatgatagtccatctaaaaatgcgtgaacaacatatagccatggagcaacaaacaagaaagaaaattcgattggttcagtaattcctgtcaatagggaagttaatgcactacttgaataaaaactgcctaccttcttacgattttccttaggaattgcgtgatacatagccaaacaagatgctggtagaccaaaaatcatcgttgcaaatcgaccagcaaaaaatcgagttccataagtaaataagcctgtgtgattcgcatctgctaattgagcaaagaaaatattttgcgcaccttggatcgtctcacctgctaccacttcacttccacctaatgaagtataccaaaacattggatagatggtatggtgcaagccaaatgcacctgtcaaacgcaatccaaaaccatataagaaggttccaaaacttcccatctctgctattgccttaccaaaatcaactaataaattctgaatcggtggccaaattatataaaaaatggagccaatcgcaattgctgcaaatgatgaaataattggaataaaacgagagcccccgaagaaaccaagaaaggctggtaattcaatttttcgatatttattgtgtaaagttgcaacagtgataccaatcgctaaagcgcccaaaactccagtatcaatgcttgctcccttatcagcaaaaagagttaaaaatccactaatagtagccgtataaaccaagtatgcaaccccagcagataggccagcagtccccttatcagcatctgccaaacctacagcaacaccaattgcaaaaatcaatgctaaattcgcaaataccgcactacctgccgtactcatgatagtgaatacagcttgcaaccacgcttgatccaatacaggaaattgtgctacagcattactatttgataaagcgcctccaattcccagtaagagaccagcaacaggcaaaattgagattggcagcataaaggcctgacctagctgagaaaacttcttaaaattcatactccattcctttctataacctatttattatttatgtaaagcactaataaaccgctctgcgatttcctttggacgtgtgatcgcaccgcctacaacaattcctgccacacctaaatcatgaataatttttacttggtcaggatagtgtatttttccttccgctatcacatcgatacctgctcggcacaagcggtcaaccaattcaatatccggtccctcctcctgcctactataggatgtataccccgaaagtgttgtcccaatgaaatcgatgcctgcttcataagcagttaatccttcctcaaaggttgaaatatctgccataaaaagttgttcggggtatttttccttgatttgcttaatgaaatcaacaatatcgagtccgtcataacgctcacgcttggtacaatcaagagcaatgacttcaatatctagagctgctaactcgtctacttctcgcatcgtagccgtaataaagggctcttgtggaggatagtctcgcttgataattccgataattggtaaagtagttacttcttttatctccttaatatctcgtacactattggcccgaataccgacagcccctgcttcttgggcagccttgactagtaaaggcataataccgccttcttccctatacagaggttcgcctggcaaagcctgacaggaaacgataattccatccttaatttgttgctttaaatctgtcttactaatagtgcccattatgtcattcctttctgctccatactagagatagcgcttacattgtttattatatagtatattattattttttcaataacctctttttatttagaatgtaatttcgatttttgtagaaatacaaaaaatcctgaaaatagtttcagaacgagttctcatacctaaaagtagtttttaggaaaatataaaagattctacccaaaatttgaatagaatccttattttaataccattttcttgtgataagtttctgacgaatagtgtttagctcctagcctctgtggctaagagagtataatacattgccagattactctatcacctcatccgcatactgtgggtataacgttgttccccagatggttattttacgttgaccaacaagtggtaaatctttgtcataaactgttctccaccactcccatgctaatcctgtacattcttgaatattgacatgaagattgcgagcatttcctggaatttgaatggtttcactccagtgtgaggtcagatttacaccattcttatcccaagcttttggttcccaaacttcttctccagcttcattgtaagatacttcttcccaagtaatgttgtatttcgcaacataagcacctgaatgatccaatgtcaatgcactgctattatggactgttgaagttgtttctatgtactctgaattgctcaaaatctgagcaggtctattgtctttgacaaagttggttgaatacgaaatcggaacacctggattgagttttccgtatcttgcaccttcttcaataatcttcttcagtgtttcaatatttccgctcacaacagtagccgcgctacctgcatccccaccaaaaatataagcagagaatgaagtatttttcagaatgtcttgatactcagcattgccactaatatcaacgcctttgatggctgctttaaatgcggcttgaacttgggtactcctactgctagtttctaacttgatgaacatagagcgtccataagaaacgctggaaacataaacaggaggtacctcatctgttatcccatttcgtttcaaatcttctacagttgtcccttctgcaaaaagcttgcttggagattctggttcatcaacactaactgtataataaatttgtttaaagttaacaatctgaacctgtttttcacccgaattcacggcatcaaaattgatatctaatggtacagcaattttttcaaaagaggttccgaacttcgttttcaattgtgacatactgtatgccattgtttcatcatattgaagctctgcttgggtattgccatactctccagcatacgtattattccatttagacagaaggttattcacccctgttcgaacagtacttcttgttggagaatttacaacagtgtggctatccccattggccaaaccaggtaaattcaaactaagcgtcagatctccccgcgcaatactgataagcgttggattattatccagaagattttggtcagcacgcaataaagcacctggataaatatttgcagccttagcatcaataacagcaatatctgcactattgttcgtaatattcttcttttctctgcgaagtactacaaaacgtccgttttctaacataccagttgttgctggcggattatcaatgtattctccctcatttgtaagaatctcttgtggctcgtaagtcaagctttgaaaatactgattaatatcttgtttggaatctgcaagaacactcaatggtgtgacccctacgagtgccaaactgactattgagcttaaaatcaagtgcgaactttttctcataagttttatcctttcatgttttcactaatgaaatgaatagacataaaaaatggtattaaaaaaacaaacgtttgcgagttcattctgcacctttttagataagttgtcaagactccttgagatgaaaaacagacaaaaaacagattacgcctctctatttgttgtttttccaacaatttccggaatatttctgtaaacaacctattcattttctgttttttctgaatttctgtcagttttttatacacattatcacttataaatatttgcaatgataaccagatattatagttgtttagttcgcttttagtacaaggcaacgagctgcaggttgctagaacagcctagaggctgttctaggttggaaataagacatgcgaagcaagtcactttcgtggagtacggcaaagcgagttcaaacaatccagtggagtgtttgaagtaggaaataagaaaacggagtttcctcttgcgtcgaagtaattaaagataaactaaatgactatacctcctctttttgaacacaaaaactcccccgactagcttctaatcctattaaaaacttgttaggagagttattccattttatttatccaatcggctttatgatgtttttgataagggaatccagattgaaccattcgtcaatcatataatctgcctgaaaggaactttctggctctgaccgttttctgtgattaaaccagaccgcttgccaaccagctgtttttgccccgatgatgtcattttcaaacgaatcccctagataacaaatatcttcgcctgacatccccaaacgttcttccattagttgaaaaatagcaggatttggctttgtgataccaacttgtccagaaataaggacatgttctagctcaaaccaattaactaaccccatcgtgcgtatctttctcaactgatgtctataaggtccattcgtaataatccccattgcaattccttgcacctgacaccacgaaaatatttctggaaacactggactgagctctatctgcccttgaaaataatcataatctatttgaatagctaaggctgttgcatcagacacctgatacccaaaatctgccaaagcatgtttcatccgataaatatgactgtctttcaaactcatctttccaattgctgtcgcttcaaatacttcatccgcatatctgcgaaaggaaaggtagagtggttcaatttgctcccttgctacttcaatgtgtctttccaaagcacgttcaaacggttgaatctgatcataaagcgtatcatctacatcaaaaattaaggctttcatgagtcaattatagcaaaaaattccagcaaaagcttggaatttttaactgcttattacacctttgcttgaatctcatgcatttgagcatatactccaccacgtgcaaccaattcttcatgcttcccatgttcaataattcgaccttgatctaagacaagaatctggtctgcattttgaatggtagaaagtcggtgagcaataataaaggttgtccgaccttctttcaccacttccatggcatgttggataatttcttccgtctccgtatcaatatgagaagttgcttcatccaatatcagaattttaggatcagagtagagtgtccgcgcaaaggcaatcaattgacgttccccacttgaaaaggccgcccccttctcaacaaccggttcatcaatccctttctctaagcgagatagcataggccctgcaccaactttttctagcgcctgcatgattcttgttctatctgcttcctcttcattcatggaaacattgctggcaatcgtccctgtaaagagatagggatcttgcaaaacaatccccatgtgactgcgcaggctttcacgagaataatcacggatgtttttcccatcaatcagtacacatccctcctgtggatcatagaaacgatagaggagattcataatagaagacttaccagacccagtatgcccaaccagagcaactgtttctcctttttctgctcgaatggtaatatctttcaaaactggtctgttttcttcatagctaaagttcacgtgttcaaacacgacttgcccttgttcaacttccaaaatacgatcacagtcgtcctccagctcttcttctagaagggccattagacgcttacctgtttcaaacgagcgaagcatatttgggaactgttgaaccagcgctcccaaagcaatgaagactccttcgatatagttgacataaacaaagagtttcccagctgtaactccatcctgtcccgcaagaaattgatagccgactaccgttaaaatcgcagcaatgaccaaattttgcagaaaaccactcagattccacgtggcaagagactgggcccagataatcttattatctgcccgacgcatcttgtcagcagtcacttcaaattctttcatgatgcgctcttcttgtccaaaaagttgaatcaaacttgcaccattcatggtctcattcacctgcgtattgacgtcactccttgcatcataaaaatccttcatcggcttgtctgtcattttcttgtaagcaaattgaataccgatatagagtggtatcaagagtaacatcagccaaccaagactcctattcatataaaataggacaccgtatgtaaagagcaaacgaacaatattgttaaaggcattaactaaggtcccataaaattgtgtccgcagagtttctgtatcattgacaattctagttgcaatttttccagcgggcttatcatcaaaataagaaataggcaaccgttgcataacatcgtaggcttgattacgtagattttcagcaatacgattggcgcaatgcatgagtaaacgcatagataagtagaagccaatagctcccagaataatcattcccatgtattgaactgactggtttaagaaaacagcttcatcaaaaggcaaacccttgctcaaatccgtaatcggcccatcaatcgcctgctgaatcagcagaggagccaatcgaaccatggtcgaagccaatagatagaagccgacagctactataaatagacacttgactcgacggatttgttttaataaaaaacctaaaatagtcattactctcctccttcctggctttgttgtcgttggtattgttcatagtaccaacctctttgggcaagcaaatcagctggacgcccttcctcaacgatacgcccctcatccaagactagtacccagtctgcatggttgacagcagatagacgatgggtcacgatgacattggttttgcctgcacgttctttttgaatattttggataatctggcgttctgtcctagcatccactgccgacaaagaatcatctagaattagcaaatctggctctcgcaggaaagcacgggcaatggaaatccgttgtttctgaccaccagaaatagacacaccacgctcaccaatcatggtatcaagaccatcactcatccgttttaaatcttgactaaaagctgctgtggcaatggcttgttcaatctcctcagagctactagctactttccctagggcaatattttctccaacagaccttgaaaacaaaatgtgttcttgtggaacatagccaattttttcctctatactagaacgtttaaagtctaaaatagattgatgattgatgaaaaaatttccctgaccaatcggatactggcgtaagaattggcgaaccaaggtcgtttttcccgaaccagttttcccaacgatacctacagtttgccctgctttcagtgtccaattgatgtcctgtaggctggctctttccgcctgtggataactaaagctataatttttgaaggaaatactagacagctctgcaatttccttagaaccatcagcctccaaatcatcacccgtctcaatcagctcttgcagtttttcgaaagatgtcttaccagtctgataaacaaggatgaaatctgctagtgtccaaaacggctctaaaagcgaaccgacatacaattgaagggcaattacttgtcccaaggtcagttgccctgctttcacggcttgtgcccccatgagaagtacgaaaatagtagacaatcccaaacagactgtggctaatggattatacaatgattgcaaggaagtgatgcgatccccaccttgagccaattgcttggtacgagcttgaaattgagccttttgatttgcttttttactataagcccgagtcactcgaatgccttcgatgacctccaaaacttcattattgagctgggctacagcttctctattggcatcaatcgccttatcttgttttctcccgataaaaaatatacatagtgtcatgaacagcatcggtagtaaagctactagcgaaattttccaatcaataaagaacatcgtgggaatgataaaagccaacataccgcctgcatagacgacaatcataagaccgtaacccaccatctccatcaggccatccacatccgttgaaaaacgagtcatgacatctcctgagcggaatttttcataaaatggagtccgcatggtcactaattttttaaaggcacgttgctgcatatcaaacttgaaattgacagaggcctgaaataatttcagatgccaaatgaaggctgttgcatagttcagcactgttaccaataacaataaggtcatctcctgaaccaatatggcctgtgttaattcattcttggttagtatatcgaccatccgctgaatgatttgcgttggtagcaaaagtgtggcgtcataaataatcaaggtcacagcaaccaatagatagagccacttatgacgcttgatatagtcaaaaattaatcgaaacatatatctcctttacaaatccataacctatcatttgccactttattcaataagctacaattgatagaccttacttttctaagctaagcgcacaaaaaagcccagggaagcatctcactccacctaggcttgcgtaagtccacaaaaatagaccagctcttgaacatagtcgacaatttttatcacaccatacccacagtgcttgattgtctcaatgtttcaaaatatagcccacgaaaaacgacaaaagttcatcaatgagctttgttttcctgcttagaaaggagtgtatgataaaaaatagcttgctgaatgacaagttgcttgttcatttgttttactcctttcatatttctaagccctattctaccataataaacattcatgtcaagggattttttgacaataagggcgaatttaggacaaaaataagaaaaaaccttgtcaaacaaggcctttcgatagtattcgatgctagttgccgggattgaaccggcgacctcatccttaccatggatgcgctctaccgactgagctaaaccagcagtacttgactagtatatcatatctctaaaaaaagtcaatggattttttggaaatattgagaaaaataaagagaaaataagtcattcctaaaaattgtctgacacttttaaggaattgtgctatactattgttataaaaatcacaaaggaaacgatatgaaactgcaaaaccttcaagttggacaatcttatttagtcaaagattgtctaacgcaagatgatattcgtaaacacttagcacacttgggtttaaaagtcggagaagagattcgcatcatttcaaaaaccaagaccaatgcaattttccaagtcaaggcaagccgtctagccctagacagagaaattattgaatctctggttttaacagaaaagtcagctacggaaataatcaatctatccgaggcacctattggtagctcagctaaggttatggacatctatgcaacaggtgcactccgtcgtcgcctcatggatatgggacttacaaagaacacgcagctatttctcaaaaaagtcgctcccctgggcgatccaatcgaaactaccttgagaggatacgagctgacactacgcaaatccgaagcgcaaatgattggtgttcaaatcacaagcgaggtgaggaaatgacaaaacacatcgcccttgcaggaaatccaaatagcggaaaaacaactcttttcaacctcctaacaggaaccaaccaacgtgtcggtaactggcctggagtcaccgttgaaagaaaatctggaacgatcaaaaagcgaaaacatttactaattcaagatttaccaggtatctactcgctgtctccctacacaccagaagaacgggttgccagagattatttgatagcggaccaaccagctgctatcctcaacgtccttgatgcaacaaacttggaacggaatctctatctgaccttgcagttattagaaatgggccttcctattgttatcgccctcaatatgacagacgccctgaaaagtcaaggtcgctcaataaacagcgaccagctctcctatcaactgggagttcctgtacagcctatcagtgcactaaaaaagctaggtatatcccagctcctccatgaagtagaaaaaattaccaatcagcaagccgagccaatctatcctcagtatgacaaacaatttgaagccggcctcgcccaagttattgacctattatcggattccatcccaaatcgtcaaaaacgcttctacgccattaagctactcgaacaagaccaagtcattctagaccaattgcaactaaatgcacaagacatgcttgatttgaccgaaatcattgccattttggaaaaaatttacgcagacgatatggaagccattatcgtcaatcaacgctaccaatttatcgagaaaatcacagaactggtcacaaaagacagcgataaggcttttaacctgtctgataacatagaccgacttgttaccaatcgttttcttgccctccctatctttgcggcagtcatgtggctgacctacttcctgtctattcaaacggtaggtacaatggggactgactgggtgaatgatgtcctcttcggagagcttgttccaggccttattcaggcaaatctagatcgatttgaaatcgctggctggctacaatctctggtccttgatggcattattgcaggatgcggagccattctaggttttgtaccacaaattttcgtcctcttcgtctgcttgggaatcttggaagacatcggctatatgagccgagtcgcctttgtcatggataggatttttagacgttttggtctatcaggcaaatcctttattcccatgttgatttccacaggctgtggcgttcctggagtcatggcaagccggactattgaaaatgaacaggaccgaaaaatcaccattatgacagcaaccttcatgccctgttctgccaaacttcctatcatttcactggtagccggtgctttctttcctgacaatccttggattgctccaagcgcctattttgtcggtatggctgccatcgtcctatccggaatggcactaaaaaagaccaagcaacttggtggagtcgcaagcccctttatcatggaattaccatcttatcacttaccaaaactcagtacggttctccggtatgcattcgataaggcacttagttttatcaaacgagctggtaccattatatttgtgaccaacatcattatttggttcagcagttcctataattggtctttacaaatggtagaaacagatgagagtatcttagcctccattggacacagtttttctctcctctttgccccacttggtttcggaaattggcgagcaactgttgcagccattacaggtctcttagccaaggaaaccgtcattgccacctttggtatcctctataaattaggagaaacaaccgaagaaaatcccgaactatgggggcttttacaacaagactatacagcgttatcagcctactccttcctagtcttcaatctcctctgtgccccttgttttgcggctattggtgccattcaccgtgaaatgggagaagccaagtggacatggattgctatcggtttccaaacgggtttagcctatgcaagtagtttggttatctatcagattggtcttgtacttatccacggacaattaccaaccgtctggacatttatcgctatctttctaattatcacagccatctacagcctagtgaaaaaaccaaccaacactcttccaatcgtcacgctaaaaacattagaaaaaggagaatattaatgcccacacttatcctctttctcatcatcgtcatcttattttctcttgcgattcgcagtctcatcaaaggaaaaggatcctgcggagattgttcctgcgactgtactattaagcaagagatgaacgaatcttctcaccatagacatccataacaaaaaggtctgcctcattattgtgcagacctttttacatgtagcttgtctattaaatttttaagtagcggttcatggaaatgactgatcccaaggaaccaataataataccaattacaaaaagtgcgccaatcattcctggaacaaagacatccatactaatcagagacaaatcttgactagcaagactagcatttaccgaagtataaatcatcttataaaaagaatagactaaagcagaaggcaaaatagctccgaggagacctacccaggcaccttcccagaggaatggtccacggatataactgtttttagcaccaaccagacgcataatctgaatttcacggctacgagaaataatggtaattcgaatagtattggaaatcaagaaaacagcagtaaagagcaataagccagttgctgccaatccccatgtacgaactagattagctaatttaaaaatacgttccgtttcaacttccccatcccgtacctctgtaacaccatcaattttagcaatctctgctgcaacagtttttacatattgcggttcagtcgtatcaatgatataagcatcgtaaagtggattggcatctccttggaataggttccaagtatctcccaaggtagctgttaatttctgtaactgttcatccttacttgaataagtgacagattgtacattttctaaggctgtaatctgattatacacctttttataatctggattagctaccgtctctcctgcttcgttcacaatcgtctcagcttgatcggttgaattcgctctcaaatacacattgatgcgtacattctgttccaaatccgaagcgagctttgctgtgttcaaaataactgaagcaaatagaccaaccaaggtaagggtaatggctacagatgaaatggctgcaatcgtcatccaaccatttcgcttcaaactcttcaatgactcaataaagtgtctaaaaaatcgattactcatcgtatccatattctccttccgcttcatcacgtactacacgaccatcttcaatcgcaataacacgatgacgaagtgtatttacaatctgactattgtgtgtcgccatcaaaatcgttgtcccctgtaagttaattcgctccaatagattcatgatttcccaagagttttcagggtccaagttaccagttggttcatcagcaatcaatactttaggattatttacaatggcacgggcaatagcaatacgctgttgctcaccacctgaaagttcatttgggaaagaacgaattttgtgtttcaaaccaaccaaatctaaaacttccattacacgtttcttgatattccgtggtttctcaccgataacttccatcgcataagcaatattttcaaagacagtctttttaggtaagagtttgtagtcttggaaaaccactcctacactacgacgtagaagaggaacatctctctttttaatttttgcaaggtcaaacttaccaacctttagactccccttatcgagcttttcctcccgatacaagagtttgataaaggttgacttacctgcaccagaaggacctacaatgtaggcaaattctcccgcttcaacattgactgatactccgcgaagggcagtcgttccgtttccatatttcttggaaacgtctttcatttctattattcccataggatttcctgtcttagacagtcctttctttagatttgagaacgtttttttcaaaatacagtccgtattctctaaaaaaacttccttgatgagcgaaaaactatctcttatttacaagcacttcacttgtaaatacaggttcttagctaattcgccattttaaataagcatctataaagccgtccaagtctccgtccataaccttatcgacttgagccacctcataaccagtacggtggtcttttaccattgtataaggtgtaaagacataagaacgaatctgacttccccaagtgatctctttcttgtcacccttaagtgagtctacttctgccgctttcttctcctgctccaattgatacaatttagcctgcaagagtttcattgcacggtctcggtttccatactgagtacggtcaactgtggactgagtcacaatccctgtcggaatgtgcgtcaatcgaacacccgttgaaaccttattgacgttctgtccaccagcacctcctgaccggaaggtatccatcttcacttcatcatctctgatttcaatttcaatggtatcatccaactcaggcattacctccacagatgtaaaggaagtatgacgacgcttagctgagtcaaaaggtgagatgcgcaccaaacgatgaacacccatttctgacttaagcaagccataggcgtttggaccagtaaagcttagagtcacagacttaatacctgcctcatcaccagcttgataatccaatgtttctactataaaacctttggcatttccataacgctgatacatccgcaggagcatttctccccagtcttgtgcctcggtaccacccgaacctggatggatttccaagatagcgttattgtgatcatagggttctgataagagcaaggtcatttcgtaagcagtcatggttttgtccaattccactaacttttcaaccaactcatcccgcacagactcatcttctgctagaaaatctagcaaaatttcagattcatcatataaatccaacatctgatggaaatttccataagtattttttaattcattcaactcctgagacgtcttctgggctgccaaattatcattccagaaatctggctccgtcatcttgttctcaagaatggcaatctcttcttccagaccttctaagtcaaagagaccccctaaaagaagttaattttttgccaagttcttcaatcttttggcgaatttctgctgtatccatatacacctcatttttattcataatctttattatatcacatttgcaagtccttgaccatgttgagaaaggccgcttgctctgctatgacatcatcattgtctgatgaaatacctgcgataaaggaaaccatctcatcattgggctgtttgaccaattgccccaaggcccagatagccgttgccatgtggaccggattttgttttttatcgatgatttctaggagtttgggaatggcagagcgatcattactattagccaaggctatgatggcattacgctggagaatatttttcccccgccaagaacctgcaatcataccaaatttttccttgaattgtccatttgacaagtccaagaatggaatcagctcaggctcagccaaatcagggtcaatctccaccacaggtggactggaaattcccttgttgtaaggacaacaaatctggcaaatatcacaaccatagatgaccgtcttgattttcttacgaaactccaagtccatcatccccttatcctgggtctgaaaggacagacagcgacgggcattcatggtcgtgtcacctaatagacaagacgtcggacaggctgcaacacagcgattgcaatcaccacaatcataatctactggttgatctggttcgatgtccaggttggtcactaattctcctagaaacatataggaaccaaattccttagaaatgactagcccattcttcccgataaagccaattcctgcacgacgagcgaccgctgtatccaccaaagctcctgtatctaccatagccttgtattccaaaccatccgtcagtttctcaattccccgtgccaaacgctccatcttatcttgcaagatatagtggtaatcaagcccccatgaactaggggtaatcttcccacgtttgtattgggtcttctgcggtttgacaggcaaatgtcgaggataagctaccgcgatagaaatgatagtttttgcagattctaacgacagtttgggacggatacgttcttcaatattcttgtgttcaaatcctgacgaacgcccctcttcctgactagcacgaagtgatttctccaaataagcaaaatcatcagccgttgtaaaaccaatcttcgagattccgatttcctgagataatttaataatctcttccttaatattcattatattcattttagcaaactttgaatatatttagcaagacctacatggctaaataagttattaatataacaaaaaacgttagcacaaaacaaaaaatattcatacgaacataggccttctcccgccaaatactggtcaagacatacatgatattaataccgattgctccccctaagccgttagccagtaaatcagttatatctgcaaccccaagtaaaagaagatattgcagaacctcaaagcagagactcactaacataatcaaacatagattagtcacccacgatgccttgcgaaatagcatttccatataaataccaaagggaataaaacttacaatattaaatagaatttctggaaaatccagcactccatcatagaccgctgttcctgcaaacggaattaagtttatactagcataaccatagcgtccatatacgatgctcaagtccatcttaaagataatcatccaagtaagtaaaaggagataggcaaaaaataaaaacatactcattttctttgtctgcatagaaattctcctctcaactagcatattttatcattatatcataaatgctgttctataaaatgtcacttctgtgacaaagctcgttccatattacaagtactttacagcctactaaaaacagaaaaggaagacactaccaagcctccccttattcccaaaaatatcttacttaaaatgtctgattgctatgctgaaaagccttatattgatggatttgtagcatcaaacgctcaaagttcgcttccttacatgctcgcatgatcaagaagcaatcaataaacttccacaaataaagtcccaaaaataacaagaacccaatcaagataaatagcgtaacaaaagatactgcaaaagcaatcagcttggcaaatcccaattctttattcccgacataaaaacggtcgacaccaaactcaccgaagaaaatagccaaaataagagcgacaagaggttgacgcatctcaaccatcataagaacgtttaaagcctcatcatctaaatcttctagttctttttgcagaatgaataacttatcagatggcaaataactgcttttacttaaaatataattctgaagataattcatataaactcctacctcttcaaaattatagcagtttcttattcttcaagcaagcctgtaggggaaaacagtgtcagaaatcgtttacatttttttcttttttgctataatgaaactagattacaaggaggttcatatgagagttattattcattatccaaaacctatcaaacaactatcctcccaaaaacttccgctcctggtagatggaaaaattgctgggacagttactcaaggtaaaattctaagcttaccaattacacaaccatctgttacactaagcattcgaggggataaaaaatcgagcattcaagttaaggagggcgatagggtctaaataatatagtcgaatgaattagctttcagacaaggaactgaggcgcaggctgtactgaagtacggcaaggcgaaagtgacgatgtatcaaagctaattcagatgactatggaaagtagcaaatacttcactccctactatttcagcttggctatcgtaccaatcgccttactgtttaacttaccaactcttgtcaaaaccttcctcctcatactagcactagccattactttattgggacaagcaatcttcccaaaatacattatcagtacagaaaaaagctcagaccactaaatctgagctttttcaaatgatatttgcttttagtacaaggtaacgaggcgcaggctgtactgaagtacggcaagtcgagttaacgaagtaataaaagataagctgaataactatattagatagctttttcatccaatcccaacttacgttgaacaaatttaacaatttctacaacgacaaccatgagacctgaaccgattactgttaccatccactgagttggtgtcaagatagataccttgaagaaggtattgaatcctggaatcacaacagtcgccatcaagagcaagaaggcagctacgatagaccagttaaagagtttgttcttgaatggaccaacggtaaagatagattggtaaacagacttaacgttgaaggcatgcaccaactgaatcaatccaagagtaacatatgccatcgtaagagcatccgcatgaatggcatgattatctccagcgtgctctgggtaaagaagtgcaaaaccatatacgcccaagacaagtgctgtttgaaggataccttgatagataatcgaactcaagacaccacctgagaagaagcttgagttacgaccacgaggtttgtgctgcataacacctggttcagcaggttcaacaccaagggcaatcgctggaagtgtatctgttaccaaattgatccaaagaagatgaactggctccaatacgtcccaaccaaagagggtagcaaggaagatacacaatacctcagcagtgttagctgacaagagatactggatggttttttggatgtttgagaagactttacgtccttcttcaaccgccacaatgatagttgcaaagttgtcatctgcaaggaccatatcagaggcacctttcgaaacttccgtacctgtgatacccataccgataccgatgtcggctgtcttaagtgatggtgcatcgttaacaccgtcaccagtcatggcaacaaccttaccatcattttgccaagccttaacgatacgaaccttatgttctggagatacacgagcgtatactgagtattgtttgaagactttctggaactcttcatccgtcaattcgttgagctctgcacctgtaaatacatggtcttctgtatcatttggatcgatgataccaagacgctttgcaatcgcctcagctgtatcttggtggtcacccgtaatcatgattggacggatgcccgcttccttagcgacacgaacagcttctgccgcttcaggacgctcagggtcaatcataccaaccaaacctgagaagacaaggtcgttttcaacaacgtcagattccaattcaggaatagcatcaacatacttgtaagccatcatcaagacacgaagtgcttgcttagccaagtccttgttagtggcaagaatggcttgtttatccgcatcggtaatcggacgaattgtaccgttttcttcaatttgcgttacacgtttgagcaattggtctggagcacctttaacagctacaaagaagtttccagcagcttgttggtgaacagttgacatcaatttacgtgttgagtcaaatggcaattcagccacacgaggctccgataccaagacttcacgaacgtcaaagttttgatccaaaccaaattgaacaagtgccgtttcagttgggtcaccaatcaatttaccagttgggtcaacttttgtatcgttggcaaagttcataacacgaagcgttgtattgcttgcatccaaagcttctttagcatccaccaattgaccgtttgtatagactttttcaacagtcatctggttcatagtcaaagtaccagtcttatctgatgcgatgatttcagttgaaccaagtgtttcaacagcaggcaacttacggatgatggaattacgcttagccaagacctgtgtaccaagtgaaagaacaactgttacaatagctggcaaaccttctggaatggccgcaaccgcaagagctacagaagtcataagagcaggcaagataccttcaccacgtacgaagactgaaacagccatcgttaccgctgcaattacaagaactgcatatgtcaagacttttgatagctggtgcaagttttgcttcaatggtgtatcagtctcatctgcattagcaagcatgccagcgatgtgcccaacctctgtgtacatacctgtatttgtaaccacaccaagaccacggccgtaagtaacgttagagttttggtaggccatgttgacacggtcaccgattggtgcatcttcagccaaaactgcggacaaatctttatcaactggtacagactcacctgtaagagctgcctcttcgattttgagggagttagcttccaacaaacgcatatcggcagggacaacatcacctgcttcaagcaagacgatgtcacctggtaccaagtctttagaatcaacttcgactacatgattgtcacgaagcgcacgcgcaactgggcttgacatgttttttagcgcctcaatggctgcctcagcttgaccctcttgataaacaccaaaggcagcgttcaagataaccacggccaagatgataatggcatctgtcaaaccgtgtgaaccttctgtaatcaccgtcaagattgctgctgcaatcaaaatgataatcatcaagtctttgaactgatccaagaatttagctaagagtgtgcgtttttcaccctcatccaattcgttacgaccgtagtctgctagacgtttgcttgcctcatcactagacaaaccgtccaaagaagaccccatgcttgacaatacttgctcttcgctctgtgtataaaacaaatcgcgtttttgttcttttgacaatttccttctccttctcggtcccttttttacctaacaaataaaaaagagacctgttttattaaaacaagtctcgctatttaatatattgccggaaacaagtcggattgacgacaatatcacggaattttccactagctactccctcgatttgttaactattatatcaaaaatcccgagaaattcaagaatatttttctggaaataagagattatttccacgaagtaaattcccaaagtaagttctagtctgtcttaaaaactggaaattagactgagacaaagaaataaggtagaacttactatgggacaagttggtaactgacaatgaaaaacaaacacttaactctctctgatcgcaatgatattcaaataggaattgaacaacttaagcccttctcagctatagcagctaagttaggaaaagatccgtccacaatttcaaaagaagttcggagaaatagggtgataaaagagaactctagtacctccaattgtgaggcctgccctctactcaaaaagactccttacgtttgtaatgcctgtccgaaaaagagaagcaactgcggataccagaaacagttctactacgcaaaaagagctcagcttgattatgaagttaagctctcagattcgagaacaggtgttgcactaaacaaggaagaattctatcgcatggatgagattgtttctgctgccatccaaaagggacaacacctcaaccacatcatcgcctcaaacgaaatgtcggcatccagagcttctatctaccgataccttgaaaaaggctatctgtccacaaagcccattgatttcccccgtgtcgtgaaattcagaaagcggagaatcagaaacctacaacccattcctaaaatcgccaaagaaggacggtcttacgaggacttccaacgctttctcacagagaaaggaatcagctattggctggaaatggacaccgttactggacggatcggcggaaaggtacttctcacctttaacctctccttctgtaactttatcttcgctcaattacttgataataaaacagctaatgaggtcgctaaacatctctacgctatcaagaatgacctgcatcagaaagagatggacttttgcgaaatatttcctgtcattctgaccgataatggcggtgaattcgctagagtggacgatatcgaaatggatgttcgcggagaatctaagctattcttctgtgaccccaatcgttctgaccagaaggggagaattgagaagaatcacacacttatcagagatattcttcctaaaagaagttcttttgacaacttgacacaggaggacatcaacctggtttgttcgcatatcaacagcgtcaaacgagcttctttcaacggaaaatcagcctatgaactctttacatttacctacggtgaggaattggcaacacttttgggaatctctaaaattgaccctgagaacgtcattcaatcacctcgattattggataagtaatcgctagtttttatcaaaaaataatttcaaaatagaaaggaacttgttccatccaaaattccagatagctagaacttactttgagacgtctcagagccagtaactttagtgtactcttttttcaacattttcaaccctaaaactcactattatcaacatttttagtcaaaaacagaacttagtctgagactaaattctgttgatgttatgcagttttctcagagtaacttctggaaggacgggaactagaacttactttgagaatttaccctttcatttgttttcagttgtatcattcacagacaaaaaaagaacgactatcagtcgttcttcaataacatacggaagacatgggattcgaacccacgcacgctgttacacgcctaccgcgtttccaacacggcctcttgagcctcttgagtaatcttccatatatggagctggtgggagtcgaacccacgtccaaacacctgctaacttattcgtctacaaccataggttatgtcttgctttaactttaacttgaactcgatacataactcaaacctagaccaagcgagtcagtaaatctcttttggaactgcctgactcaatcccaacgtagcttgctattttaagaccaatcagcaaacacaagcaattcgcgactggtcacgcaggcaggttattaagctgctaatgcgtaagtgtttgtattttttgcagttatatttaactggcatttttacatctgccgatgagttgcagaacaagcctcataatgcctgtcgaatccgtaacaaccccgtaggatttgatacaggaattattatagcagaattttttataaatagcaaaattattttacattttccttacaatttaaaaaaattttgaaatatggtaaaatgaaagtatgtataaattttggcaaaaaaccattcaagtattaagtattttgacccttatcgggaccgctatttttctattttggctctataagattggcattttgaacgaccaaaatgtcttaagcgatttaatcaaaagccaaggtgctttaggtagcctctcctttttagctattcagattattcaagttgtatttccgattattccaggcggtgttacgactgttgtgggtttcctcgtatttcatttttggtggggattctttctcaattatcttggaatttcaatcggtagtatcatccttttctggttggctcgtcgctatggaaagaaattttgtctcctcttcatgtctgaagatacgttttacaaatatgaaagcaaaattgataataaacgtagttatgaaattttctttattctctgcatgctttctcccatttctccagctgacatagtggtgatgattactggattaacaagcatgagttatcggaaatttattatgattactttactttgtcgccctttctcagttgtggcctatagcttcttttggatctatggcagccaatggttgcagcaattgttaggataaaatcataaccacccgtgaaaacgggtggcttgtacaccggctataagccgtttctctccagcgacgtctaaagacgttcgctgaacttcgttcaggttagtgctataattacttgactaatgcccgtaacaacgggcttttatcttgttctaaaactactatctgaaaatgaatcttcatattctttaacacttaacttatcaagtgcgatgtcatttttctcctgctcgcgaatatatttcgctaccgtcttttcgttcagtccaacggtactcacatagtagcctctagcccaaaactttcgatttccatacttatattttaaattagcatgtttatcaaatatcatgagagcacttttacttttcaaatatcccataaaatcggaaatcgaaagttttggggatatcaagacaagcatatgaacatggtctggcatcatgtgtccctcaatgatttccaccacaccaaacgcatgaagaaaaaaacgttttcagaaagcgaaaatcataaccaaagatcaatcaaagtagtacactagaatagaggtgaactacaataattgattttcttttatccatagaagagcacaaagaggagtacaacagccgtcaagcatggaaaattcgttatcccttatccactattctgtttctagttttcgcttgtcaattggcaggggttgaaacgtggaaagagatggaagatttcatagaaatgaacgagtctgttttgggagaatacgttgacttgagtgtcggctgtctttctcatgacaccttggaacgtgttgtgagtatggtcaatccagatttcttaaaggaactgaaactgtccttcgaagctagttcggaaacaactgatttttcaaaattgattgccgttgacggaaaaacgattcgggggaaccgagggaaacaccaatctcctactcatattgtcactgcttatgatggtggtaatcggattagccttgggcaggtagctgttgaggataaaagtaatgaaatcacagccattcctcgcctcttgtgtcagctagaccttcgtaagagtgttgtcacgattgatgccatgggcacctagacagacattgcggatgtgattatcagcggtaagggtgattattgcttggcagtcaaaggaaatcaaggcaatctccatgaggatattgacctctattttagtgacgccaaattgttatctacgttgacagagaaaggctgtcattatcagaccattgaaaaggcacgcagtcagattgaggtgagggactactgggtttctcacgatgtgaaatggctgagccaacgacatccgaaatggaaaaaacttcgtgggattggtatgactaagaatatcattgataaagatggtgtcatcactgaagaggtccgttactttatccttagtttcaagggcgatgtgcaaactttttctcaggttgttcgtggtcattggtcggttgagagcctacattgattgttagatgtggtttaccgagaagataagaaccaaaccttagataaacgagctgctttcaatttaaatgctattcgtaaggcttgtcttcatctcttacaaatgatgaccttccctaaggagaaattgagttaccgccgcaaacaacgctatatttctgtccatttggaggattatttgccacaattatttggaaatcggggataaggtgcttgtaaaaaggtagatactaagtttaaagcagttatttccggggacaaaaggagagaagaaatttttcatgcgtatgacgtgatgtccacgcctttgcatcgacatagatgacggaaaatatcaattaagtcctgccttattttgtagtaaatggattttctacggtacttaggtgtgaaaactatgtgatagagcacatccatttagtatgtgataaactgtaactggttttagccatttctttttcctccttgatctaacctgaacaattagattataacaggaaaaagaaatggaaactcaaagccttggcagccaccagcatagctggtggctttcttgtttttctctacgagaaaaactggctcgaagccataataaaaaaacggcttcaaacgttcgaaaccattttgtttttttatttaattcctaatgcaattcgagcataacgactcattttttgaacggtccaagctggtgaccaaaccagtctcacatctacttctgttacttcagggacatccttcaatacatcatgaatttgatcggtaattagatcagctaatggacaacccatggtcgtcaaggtcatatcaatttcagccttgccctcaataaatcggatttcataaattagccctaaattgataatatcaatacctagctcagggtcaatcacatcttcaagagcatgaaaaatacgctcctgaatgtctttaatttgatcttctgtgtacgtcatttttctctctttctttttcacaagttcaatactagaaaagaaacaaacgaagtttgtgtcaaaaagtccactggacgttacgctccctttctaatttcaaggggagcggttaaaatctcgctcgtttcctgttttcagcgagcggttgattttgtctcccagacaaaatcaatcctcaataaaatctcttagtggtttgctgcgggatgggtggcggagtttacggagggctttggcttcgatttggcggatgcgttcacgggttacgttaaagactttaccaacatcttcaagcgtacgcattttaccatcatctaaaccaaaacgaagacgcaatacgttttcctcacggtcagtaagagtatccaatacctcatctaactgttcacgaagaacgacacgagttgtgtaatcaactggattttcaatgacttcgtcttcgataaaatctccaagatgactatcatcttcttcaccaattggggtctcgagtgaaacaggctcttgggcaatcttgaggatttcacgaactttctcaggcgtcatatccatacgctcagcgatttgctctggagttggatcttggcccaattcctgcaagagattgcgttgttcacggaccaatttgttaatggtttctaccatgtgaacagggatacggattgtacgcgcttggtccgcaatggcacgagtgatagcctgacgaatccaccaggttgcataggttgaaaacttgaaacctttagagtagtcgaacttatcaacagccttcatcaagcccatgtttccttcttggataagatcaaggaactgcataccacggccgacatagcgtttagcaatggatacaaccaaacgcaagttggcttcagccaaacgttgtttcgcttctgggtcacctgcctcaaccgccaatgccaattcttgctcttcctcgttggtcaaaagaggtacaacaccaatttctttcaaatacatgcggactgggtcgttcacttttgcagaagtgcttccgagcaattcttcatcagataattctggttcttcctctacctgcatagcacgagcagaagggttcccttctttatcaacaatcgaaatccctgcgtcctgaatacgttggagcaaatcatcgattccgtcagcatcaagcgtaaatggaataaccagttggtcattgatttcatcgtctgtagctgaaccttgttttttatggttacggataaattcggcaacttgtacatcaaaagtagttacttctgtttttttatcttttttatttgtcatatttactccatttgtcttcttctatcgaggagtttttgcaactcatcgagggcaatatctgcatttcccacatgggaatgttcacggattttccgtgctaggtgctggttctccttctttaacaattccttgtctcgccgaatttctaattcttcgatttcgtgtggagacacttcatcaggtaaacgttcttcctgcatacgataccaagcctgttgagcggaatcgttcaactgtgatagttcaaaactggtaatttccccagatttttttaacatatcataaatagcttgcaattctggcgtcgcaaaataaaaatcttctcgtaaacggaactcattgagaatataaggatgttcaaccatccgataaagtaaatggttttctgttcgaataagactcgttatacgagcaatcgtttggactggtggcaaataagactgaccagtctgtgattgaaatacctgttgtgttctctcctggcgctgattcagacgaacagcatttactgcctgttccacctgattataatcaaagtcagaaagtaaatccgccaccttataaatataagaattttgagctgtaatggatgatactttggcaataattggtgcaatcttatctacaaactcaatctgcatttgtagattgtcaggattttcaggtttcaagtattgaatcaaaaattctacatcgctgattcgtgacttggttaaaacctgttgcaaggcttcttccgaatttttctgcaaaaattcatctgggtccatattatctggcaagctcacgatttcaacctgaaaatcttgtagttcgtccaacgctttcatggtagcagcctgtccagccttatccccatcataagtcagaacaattttcttacaaaacttagctaggtgtgcaacatgctctcttgtcaaagctgttcccatggaagccactgcattatcaatccctacacgatgagcagcaataacatctagaaaaccttccatgagataggtttcacgttgcttcttaataaccgctttagccttgtccaaatgatacaattcatagcttttattgaaaatcgcagtactacgagagtttttatacttggctaattgtttattgtttcgattttcttcggtccaaatccgacctgaaaaagctacaattcgaccatattcatccgccaaggggaaaataatcctcgcttgaaaggcgtcataaataatattattctcacttggattgaacaaacccgaattcaatagactttcttcgtcatattgacctgatagtttttggtaaagaatattctgttcggcaggagctaagcctagctggaatgtttttatgacatcatctgtcaagccacgttggtgtagataagctctagcttcctcacccattttagttgtcatcaaaagggcatgataaaactttgcagcatcccgatgaatatcatacagtacctgatgcggactaacccttttctcctcttgatgataggaaggagttacatctatttgaaaccctgccttctcagctaagatagctgccgcatctgcaaaagaaacaccacgaacttcttcgacaaacttgaatacatctccggacttaccacatccaaaacaatggtagaactgcttatcttcaatcacattgaaagatggggttttctccccatgaaaagggcaaagaccgacataattacgtccggccttagtcaaagcaaccgtttcaccaataacatcaacgatattgagagcttgttttatttcagtaattttatcctttgaaagcacattccctcctcatatcatactagctaatttaaaaagtgaacactctccccttagtttaacatactctattgtatactaaatatgggaaaatgtaaaatttctaaaacaaattgcttgtaaaatatttttttatgggtataatagataaagtaaaatatttatgaaaggacatatttaggatatgttgaaagatttaaaagcatttttgttccgtgggaacattgttgaccttgctgtagcagtggtaattggcggagcgttcggcgcaattatcaaatcatttgtaaatgatatcatcactccattgattttgaacccagctttgaaagcggcaaatgtacagaatattgctgaccttgcatggaatggtgtgaagtacggtagtttcttgagcgctgttattaacttcctaatcattggcacttcaatgttctttgttgttaaagcagctgagaaagcaatgcctaagaaagttgaagagaaagctcctgctggtccaactcaagaagagttgcttgcagaaatccgcgatttattgaaaaaataatcaataatatattgaaaaacaggtctccatacctgtttttctcttccataattacaaaaataagatgtgagcctccactcacatcttttcttatccttcgtatccatttggatttttcgattgccagttccacgtatcttgacacatgtcttcaattgttttttctgttttccaatttaactctttccaagccttgtctgcgttggcgtaacaggttgccacatcacctggacgacggtcaacaagtttatagtgtactggaacgccatttaccttttcaaaggctttgaccaactccaatacacttgttccttgacctgaaccaagattgtaagtatatacacctgtagtagttgaaattttttcaagcgccttgatatgaccgagtgccaaatcaatcacatggatataatcacgcactccagtaccatcaattgtatcataatcgttaccaaaaacgctgagttcctcacgtttaccaactgctacctgtgcaataaacggcatcaaattattaggaataccagctggatcttccccaatcaagccagattcatgggcaccgattggattgaaataacggagcaatgcaatactccactccttatctgctacttccacatcacgcaagatttgttccaacataactttggtatagccgtacggattcgttgcgctagttggcatagtttcaaccaaaggcgatggattattgagaccataaacagtcgcacttgaggagaagacaattttcttaacactaaattctgtcatgacttctaccaaagctagggttgacatgatattgttttcatagtacataattggcttagccactgattctcctactgccttgtagccagcaaagtgaatggctgcctcaatgttttcattttcaaaaacttggcgcaaggcttccttatctgccacgtccaactcatagaaagttgggcgcttgccagtgatggtttcaatgcgatctaaaaccaaaatacttgagtttgaaagattatccacgataaccacttctttccccaacttcaacaattcgacaaccgtatgactaccaatataacctgcaccaccagtaactaagatactcatctttttactccttttcacctggacaaaattctatatccctattatatgttacctgttgtaaaaagtaaacaaaaaacagcctttcggccgttttcaaattcaattagaattttttacgcttgcgagctgcttctgatttacgtttacgttttacagatggtttttcgtagaattcgcgtttgcgtgtttcttgaagagtaccagctttagtaaccgcacgtttgaaacgacgaagagcatcatcaagtgattcgttcttacgtactactgtttttgacatttttttcactcccctcaatttcaaagtctttatcattttactatgattcaactcatttgtcaatatttttttcattctaaaatatgaattttacgctcttatcctatcctattcttttttcctgtccacgccagtattgtccaaaagaagaattcgtaaaggacaaaaaataatacaaagcaatgcaagaaaaactcttggggcaaaatatatatgacaggatcctttgcagggtcaaatagccatgtagaatctcctggaaatagcaccgtatgaaacaatgcaaaaaactgatcaaagccaacaagaactcctaataaaccgattatcattggcgtaagcatggtccagaaaatgacctttttaaccaagtctccataaccttttagcagaatgttttttacaaaaagcacaaaggcagggagggtgaggataaaaattccctgagttagatggaataaatgtttcacatccgcaaaatgtttcagaccatcagctgaggatgaaaaatttggcatgtctaaaacacttgcaaaaggatttgttagatagttcatcaggatattgaaattgtaggaaatatctgccaccttcatgtagaccactttttccaaccccaaaaaagaaatctcaagcggataaactagccaagctaggtagatggttcctagaactgctgccgataagacaaataaaatcgttccgataatctgtaacttagttctcatcaaaactccattcatctaggctgttgaggacatgggttggagccaggggtaagtctgctacttcttctggcttggtaaatcctgtcaggactaaaagagttggaaatccattgtcaatccctgcacgaatatctgtcaggtagttatctcctaccataactgtctggctgcgttctgtgcctaaaatctccagagccttgtccatgataatggcttcaggcttaccgataaaggtcggctctactcgggtagcagctttcaaaagcgcaataagtgagcctgctcctggcaaatgacctctttcagtcggaatgttcaaatcaggattggtaccgataaaggtcgctcccttttgaatagccaaggtggcaatggtcagtttttcataggtcaactgagtatccaaaccgacaacaacataggctggattttccgtgtcttccacataacctgcctcaaaaatggcagacttgagcccgtcttctccaatgacatagactgtcttttccttgcccaagtcattcatataatctactgtcgccagactggctgtatagattgtttcaagcggtgtctcaatgttaaagttttcagccaacatagcctgcaccatctcaggacggcgggtggtattgttggtcacaaataaatagggaatctgacattcttgcaagcgatgaataaaacgttcaccagcaggaatccgctttttcccttcataaatcgtaccatccaaatcaatcaaataacctgtatatgtcatttttcctccttaatcaaatcgtgtttcccaatgctcagaccgactagcttccaagcaaagtgctaactgctcagctgtatttttcccaaggtagagcggtggtaagtcatctagactgaaaaagccactggcaactgtttccgaattgggctgaaactccccgccaaggagacgacatagaatgaagaccttggtcacgcggtgggctgacttggcaggattgttcttgtgtttgtccaaaatcgccaccacacgttgagcctccacatccagccccgcttcttcctttacttccttgactacattgtccttgacagactggtccacatcgcaccaaccgcctggtaaggaccagagcccatcgttttcctgaaccagtaggattttatcctcttggaaaatagctgcgcgggtatccagcttgggtgtctgatagcctgtttcattgcaaaacaagtctttcactacttccaaaggctgtccagatggctctaccaacatttccgccgcaatctgtctgatttcttcgaaacgttccatgtcataaacatcttttccataggccaagcctgtctgagccaaggcttgtaaacgtacggcccattccaaccacttatcctgcgacatgacgttccctccattctatgacagcttgcgcatggatatgcccatctaccacaatctcatgctgactaccaccagcttctgccaccatacgcgaactcaccaagctagttgcctctacctctttaagatacttgagttgtatttttttagggacatggcagagcagaaaatcatagcccagtgcttcatacatccattccaaatacttgccattattgacatgcccattcatatccaagtcaaaatagcgaacaggaaattcttggacagatggattttccaagagctgatacttgggagcccgaggcaatttcttgacctgctcagactgataaggagcaatcaaatcttctggcacaggcgccaccttgcgagtttcaaaatcaatcaggacaaaatagcagagaatgtccaacaaaagattgcctgctgcatcgtagatatagaacatccgatgacagaaaaacttgttgtaggcaaccgcttctgtcttaatggtaatggtttcattgtacttaggtaaacgttgaatggtcagttcataatctgtcaccacccaaatcaagccaaattcctgaaaaacatagaggtcactgcgacccagttcttccgactgccgacctgatacaccaagacagtaggaaataaagtcaggtagtttgatttcttgtttgacatccaccatatcaaaaggaatggtgaactcttcttggtatgttagtcccataatgttgatctttctagtcttaaagtatagtctttcagttcacgtcaacagctgcaggtagcttcaatagtccagtggactattgaaggttggaaatcgtacttacgatagtaagtaacattcgtagagtacggcaaagtgagttcaaatactccagtggagtgtttgaagttggaaataaggaaacgaagtttcttcgctcgtcgaagtaataaaaacaaactgaatgactatatgaaacgctctgcaactgtatcgcccagaaacaatccctttttagtcatccgaagccaacagtcttcttcttgcaagagtccttcatttttcaagtctctgaccacctgaccgtagcggtcttcaaaggagataccaaactttttctcgaatcgctcaatggacacgccagtttttttccgtagccctaaaaacatctcttcttccatctgctcggtcttgctgagaaattcttcgtgtaagcgagaatggcctttttcgcggatggacttgaggtagtgctggatgggggcacggttgcgataacgcatgccgtcgatgtagcctgaagcccctgctcccaatccgtaatactcggagttgtcccagtacatgaggttgtggtggctttcaaaaccaggcttggtgaagttggaaatctcgtagtgttcgaagccgtttttctccaactcctgaagaatgtagtcaaacatatcggactccacatcttcgttgggtagatgaagattgccgcgacgctggcggttcatgaagaccgtgtgattctccaaaatcaaactatacaagctcatgtggggaatatctagctccaaggccttggcgacattgtccaccacctgctccatggtctgaccaggcagggcataaatcaggtcaatggaaatgttgtggaagcccgcttccttgagggccgcaatggtttcataaatctgggcctgattgtggctgcgaccaatttttttcaacatacggtcatcaaatgtttgaacgccaagcgacacccgattgcacttggactttttcagaactgctatcttatccgccgtcaagtcacctggattggcctcgatagtgaattcttccagctgtgacaagtccagcaagtcctccagattggtcaggaggtagtccaactgttctgccgatagagccgacggtgttccgcctccgatgtagagggtcttgagggctggaaggtcgtaaaacttgacctcttccatgagggctaccaaatagtcatcaacaggctggttcttaataaaaaccttggaaaagtcacagtagtaacaaatctgggtacaaaatggaatgtggatataggcagatgtcggtcgttttttcataagaactattatagcacactgtctataaaaatattttttacagccatcacttccccctcaaaacaatgatataatatagtaaacttacaaaatctacaaaagggattaaatcatgaacaaagaacgattctatgatgtcatcaacgctatcttatcattcttattctgccgctggctctttatgacctttcttttttaccagttcacgaccattttcatgacagttgatttttggccgacacttgccgcaatcctgttaatgaccggattttgctttaccctatttcgacttgtctataaaccccacatttcgcgactgacactttggtttttctacgcttgctacgggcttctgctagtctatcttctctttttcaaaagcatgggcgtcagaggtgtcaactagaatctccttagcactttttcacaagacctatttctcaatcctactatattggtttttaacctcttactctttttaccacttgggttgcttttttcattttcttggaaaaaactttctctctttgtaggtgctattttactggttgaagcctgtcaattcttcttttcactgggcttctttgaccttggcgacatcttgcttaacacttctggctttgcccttggaaaccttttgggaaaatccgcaatcgctcaatcttttaaaaatagaatacagaaaaaatgaccccgcaaggtcatttttagtttatttatactcaatgaaaatcaaaagtagcctaggaaacgaagccgacgatagaactgaagttcatctaggctcttgacaacggataattttgattttcgaagagtattagcttacttaacttccaaatgccagatgtcttcgttgtactgttgaatagtacggtctgacgagaagaaacctgctttagcgatgttgacgatgactttttccaaccagctgtcgcgatcttcgtagtctgctaacatctgctctttagtcgagatataatcttccaaatcaagcagggtcatgaagtggtcattgtgcttaaggttatcctgcaaacgccagagacgctcatcgatcccaccagcatgacgaatggtatccgatgtaataaagtcaatcaatgggcgaatggcttcacgttcgtagaaggaatatggatggtaggtcccatttgcatagtgttcgataactgtttggctatcttgaccaaagatataaatattttcatcacctaccaactcatgaatttccacattggccccatcatctgtaccgatggtcaaggctccgttgagcatgaatttcatgttacctgtaccagaagcttctttggatgcaagagaaatttgttctgaaatatctgccgctggaataatataacttgcctcggttacgttatagttttcaatcataacgagttgcaagtgtggcgccacgtcaggatcatttttaatcacctgtgacaataccaaaatcaaatgaatgatgtcctgtgcggttgtgtaagcaggtgcagcctttccaccaaagaaaactgttaatgggcgagtagggatgttgcctgctttaatatccagatacttatggataacataaagaacattcatctgctgacgcttgtactcgtgcatgcgcttgatttgtacatcaaagatggattctggattaacatgaacaccttgtgtcttggcaatatggcgctgcaatttgcgtttattatgctgctttgtcttttccaaccaagatttcaattccttatcatttttgtaatccaacagcttttcgagctcacttgcatcgtgatggtagccatgtccaagtaggccgtccaggtagcttgccaaacttggattagcatgcatgagccaacgacggaaggtaatcccatttgtcttattattgaatttttcaggatatagctcatagaaagctttcaactctgaagttttcaaaatctctgtatgaagtgccgccaccccattgatggaataaccataatgaatatccatgtgtgccatgtgaacacggccatgttcatcgatgatattgacagcaggatcatccttcacttctttggcacgacgatccaattctacgatgaacggtaccaagtgcggaaccacatagttcagaaaatcaagcggccatttttccagcgcctctgacaagatggtatggttggtataagcagtcattttcttaacaatttcaactgcctcatcaaacgaaataccacggagctccaaaaggcgaatcaattctggaataacaagtgatgggtgagtatcgttgatttgaacaacggcataatcaggtaggtcatgtaagtttgatcccttagcaaccgcttcgtcaatcaatagttgcgcagcgttagacaccatgaaatattgctggaagatgcggagaacttttccttcatcggtcgaatcatctggatagaggaagagggtcaagtttcggaaaatatcttccttatcaaattctattccgtcataaatgatattgtcatcaactgaaccaaggtcaaacaagcgaagtcgattcttgcgttccattttataaccaggtacatcgatgtcatacaacttagatgtcaaggtaaagttagcaaatggcacctgataagaaatcggtgactctgttaaccatgaacgtggtgtaatccactcgtttggcacagcagactgctgatggtattcaaataattgtctaaacagtccaaagtgataattcaagccgaccccatcaccgttaagacctagactagcaattgaatcaaggaagcaggcagccaagcgccccaaacctccattaccaagagacggttcaagctccatgtcttcaatagcaatcaaatccttaccagctgccaccaactggcttttaacctcatcataaagaccaaggttgattaaattattagacaagagcttaccaattaagaactctgctgaaatatagtagacctttttcttttggtcatttgtatacttagcttcactctgctgttttgcaaaagcaagcaaggcgtaatagagttcttggtctgtacaatcttcaatgcgtttggcatacatagactgaacaaaattttgtaaattaatcatgagggctctcctagatatattaatgtaatcattcagaaaggtttcgctttacctttgtaaacgttttcttaattataccctatttataaaaaaagacaagccaacttccgtacaaatagaaattagttcgtcttttaaacgattgcaggttactacaatcagaattattcttaattattctgcaatcagagtttccaaaccaactttcatcatatccgtgaaagtattttgacgctcttctgctgtggtgtcttcctctggattaaccaagctatctgaaatcgtcataatggcaagcgtttgaacgccaaacttagcacctaggtaataaagtgcagctgcttccatttctacagccttgacacctagttgacctaattctaagttgcgactaaacaattttggagaatagaaactatctgatgataaaacattgccaacatgcgttgtcatgttgagttctttggcgatatgataagccttatctaaaagatcaaaatcagcgatttgtggcaaatcgtactctggccagtcaatattgatcatacgagagttggtcgcagctgcctgagccaagaccaattcacggacatggacatcctcattcaaagaacctgctgttcccacacgaattagttttttcacaccatattcgttaatcaattcatgagcatagatagatatggatggtattcccatacctgttcccatgacagagacacgatgacccttgtaggtacctgtgtagccgaacatattgcgaacttcgttgaagcaaacggcatcttcaaggaagttttcagcgataaatttagcacgaagcggatcaccaggaagcaaaatcttatcagcgatttcgcctggttttgcggaaatatggatagacatgtaatgtacctctttgttctattttcgaatacttacaactcagccaagatagccttcaccaagcccttgaagttgcccttgatttgctcggttacttctacaacttcttcgtgattaagttcagattggaaaccagccgcaaagtttgtgatagcagaaatacccaagactttcatgcctgagtgagctgccacgataacttctggtactgttgacataccgactgcgtgggcccccatggtcttgaaggccaagatttcagcaggtgtttcataggtagggcctgtcacaccgaggtagacaccatcgtccaacttgatacccaatttttccgcaacggcatgggctttttcacggtattctttagtgtaggcattggacatatctgggaaacgtggaccaaattcttccaagttttcgccaatcaatggattttggccagtcatgttgatgtggtctgtaatggccataagggtacctggaccgtagccaataccacctgcggcattagtaacaatcactccttcacaaccaagagctttcatgacacggactgggaaagtcacgacttccatcggatttccttcgtagaaatggaaacgaccttgaagagctaagaccttacgtcctgccaaatcaccgtaaaccaacttaccagcatgaccaacaactgttgatttaccccagtttggaatatctgcatagtcgatgacaatagcattttcaacttcttgggccaattcacccaagccagaacccaaaatcaaaccgaattcaggttttaccaaacctttttcttccaagaacgtttttgtttcattgatttttgcaagtaaactcatattttctccttttataaataatccgaccagtcatattctggcattttttctttaatgatttcaagcggacgacagaggaaggctgtctgctctcgctcgataatggggcgattgagagtggcaggctctttaactaaacgctcaaagatttcttcttctgacaaggctagtcgttcttcttccttcaatcgaataactgctgaaggttgactgcccattttttccaagagagctgtcaattcagttccccttaatggtgtttccaaataattaacccacttgacttccatatcctggctggacagcaatattcttaattttttacacttgctacagttaggattgtaatagaccgttagcttctccattaaaccaattgtgacaagaagctttcgccaatcatggctgtgtccactccgaagttttccgcaacggttgctgaaatgtccgcaaaatggcctactggcaaaacaccgctacctttgaaagccttgctgtatgctaagagtggcacatattcgcgtgtgtgatctgttccagcataggatggatcattgccgtggtctgcagtaatcaagagcaggtcatcttcacgcatattgtcaataatctctggaatacgtgcatcaaactcttgcaaacaatcgcggtagccttcgatattgcgacggtgaccatacacagcatcaaagtcaactaagtttgtgaaggagaaaccttcctcgaagtctgataacttcagagtatcaatcaacacatcgacaccgtgcatgttggacttggtgtgacccatatcatttgtaatacctgaaccattgaaaatatcactgattttaccaactgagtaagttggtacacccgcatctgccagtttgttgagtactgttgcctcaaaaggtgatactgcatagtcgtgacggttggcagttcgtgagaaattgcctggctcaccaacgtatggacgggcaataatccgaccaagaagagctgggcgttcaagggtaatggagcgagcgtattcacagatacgatacaattcatccagcggaataatgtcttcgtgggctgcaatctgaaggactgggtctgcggaggtatagacaattaactccccagtttccatttggcgagggccaaagtcatcaatgacagctgtacctgaatacggcttgtttgcttcgcggatgattttacgacctgagaattcttcgatttttgtcaaaatctcttcagggaaaccatcccagaatgtatcaaatggctcagtaatattgagacccataatttcccagtgtccagtcatggtatccttaccaagcgatacttcttccaacttggtcacgtaaccagttggatggctttcagcaggaactgtcgcaagcgctgtatctcgagggatatttccaagaccaatcttggtcatattaggcacctcaagcccagctttttcagaaatgtggccgagagtgtcagattctgtatctgctacacccgcattgaaaaatttatctgagtctggtgctgcgccgattccgacagagtccataactaccaagtgaacacgtttaaatttaggcataattgtctcctttatttgatatagttagattcaaccaaaatcagcgtccaaccaagttgctagactggaaattatcatcaccacacctaaacattttaatggggtgcaatacttatacagtcaaagctctcggcatcaaacttcttaaccatcaaaactagatactgttactcgcttcactgcctgctgttcagctatcgctttttcagtacctatcatctgactgctacgaggtaaggggatagatttttgaagagtctaaacgttcgtgttttcattataccataaaaacgcctctcattgtaccaaaatgagaagcgttttcaatttatttcttttcgatgatgttcggtccttctggtgtaccaacaattaccttggaaatcaatccaataaagagaccgtgttctacaacaccgacggtccgatccaattcttccgccaatgcatatgtgtcttctattctgcgcaaatcaaggtcaatgataaagttctgcatatccgtgatatgtttttttccattacgcatacgaaaacttggacgatacccttttttctcaaatagtcggaaaagattttccgcaccgtactgcacgacttccaccggcaacttgaaggctcctagggtttgaaccatcttagactcatccacaatccagatgcagtccttgctattgactgctaccactttctccatgagaagcgctgcaccaccgcctttaatcccattgaagtcaccatcaacctcatctgctccatccaccgtcaagtccacatattcgacttcgtcgatattttttaggggaatcccaagggacgcagcgtgctcagccgtggcatgagaggtcgttacgcctgttatctgtagcccttcttctgcaacccggcggccaatctcctgcacgaaatagtatgccgtcgaaccagttcccagcccaacaatcatcccgtccgtcacaaattccgccgccttaatcccaacctgctcttttaggtttatcatctttgtctcctttgaagtaaaacgaatacatatagtatagcatggagagggagatgggacaagagtgagttagaaattcaaaaaataatgtcttaaatcctaaaaaatttttttcatttgttcaaatatatttgctactaacttagggacgtaggaaaccttatgagaagttagctgatgggacagtccaagaaattgaagtgccttatgatataccagagagctgggagtgggtgaggttgggtgctattgttactgctaaaggtggaaaaagaatacctaaagggtacaatctgcaagaagaagataatggtcatccatatcttcgagttacagatatgaaagatggtacgataaaaccaactaatataaaatttgctccagataatgtatatacaataataagaaattacactatttcgagtactgatatatatgtcacgatagctggaactattggtgatgttggaatagttccggaaaattttaataatgctctattaaccgaaaatgcccttaaactgatgctgacagaaagtatcaataaaatgtttttggctcatctcttgaagtctccattagttcaaaaacaattcaaagaagtttataatcaagttgctcagcctaaactgtccattcgtagcacaaactcaacaattatccctctcccacccctagccgaacaaaaacgaattgttgcccaaattgagcgagccttggaacaagttgaagtctatgctgaaagttacaataaactccaagagttagatagagcttttccagataaactgaaaaaatctatcctccagtatgctatgcaaggaaaattagttgcacaagatccgaacgacgaacccgtcgaagtcttacttgaaatgattcgtgctgaaaagcaaaaactctatgaagaaggcaagctcaagaagaaagatttggcggaaataatggtcgaaaaaggagatgataactctccttatgggaagattccgagaaattggactcttctttctgtcaaagatattttttcaattacgacagggttatcttataagaaaacagatttagctatcatccaaagaggtgtgcggattattcgtgggggaaatatcgaacccttagcatataaattattagataatgactactatattgagtcaaaatatattacatcagaatctgtttacttgaagcgaaatcaactagtaaccccggtctcttcatcgttagaacatatcggaaaattcgccagaattgataaaaattattcagatacagtagctggaggatttgtatttcaactaacaccatttatctcgtcagatactttatcaaactatctattactttgtctctcatcgccacttttttacaaacaactacaatcagtaaccaagctgtctggacaggctttatataatattccaaaaacaaagttgaatgatctccgtattgccttagctcctgaacaagagcaagaacgtatcagtaataaagttgggcaactttttcaaaaagtaaatctactttagttacaatatctttcatttctcgatagttagaaataggtatcaataatcctgaaatactagtactatttaacgtttttccttttatagcatcctttgaattaccagtggttgagattaggggcaaaaatcgcatcagatagtctcttatgatattttctttatctccgtacggaaatattgagattatcgcttcattatggctagcagggacctctaatgctactttaccaatagttaacttaaaactcatcaacaaggtgcctgccgaagctatctttaccttcttctgattaatagcaaaatctgatagatattcttttgttttgaagatgtgaccattgttagacatatctgaaatagatacccaaggaatatcgtctccccaataattcggctcacttcttggaggtgtttttccaatattaaataaaactagaccaccaaacttaacgtagcaccaagaactaggaagtttaaacaaagttgaattactaaaaccaatattttccttgttcttcccataaggagagttatcatctcctttttcgaccattatttccgccaaatctttcttcttgagcttgccttcttcatagagtttttgcttttcagcacgaatcatttcaagtaagacttcgacgggttcgtcgttcggatcttgtgcaactaattttccttgcatagcatactggaggatagattttttcagtttatctggaaaagctctatctaactcttggagtttattgtaactttcagcatagacttcaacttgttccaaggctcgctcgatgtgagcaacaatccgtttttgttcggcaagcgggggaagggggagaagtgtatctccaaaacctgaagcagaaatctccttaaatgtcgtacctgatgatcgtagaataatatcttttgttcgaaattgcaaaatccaatacataaaatctaaatttactagtattggcgttacggatttacaaccttgatttgtagtaaagtcatagttaacaatgtttatatgtcctattggagctcgactagaataaacaatagagttttttgaaattagttgagcagaagatttttgtacgcctaattcggtaattttttttgatgaggtggcaaataatttattgttttgctgtttacccatatctgcaggagttatccaagtgatattcccatcataataagtagattcagaagatttcggtgtgcctcccgaagtaataactcctaaatttcttaacctcacccactcccaactatctggaatttcataaggtacttcaacttttttaacagtcccatcagctaacttctcataaggtttcccatcatcactacgaaaaaattctgtttcctttttatctcgcttgacttttccttccgaaatcaacttctctttctcttccttgatacgtttcaaaagttcacttgcaggctcatcatttgggtcttgcggaacaagcttaccctccatcgctctttgcaggatacttgctttcagttgttcaggagtcattatttctcctccaaaatttctaaaatttccgccaaaacagtatcaatttttttatttaggacagctcgttcttgctgatagttttggataagttcaagtggctctaaaatttcttcctcttcctttggaaaaccgcattgatcaaaattatagtttaaactagctaactcatctggtctaaacgatttagatttgtagaaattcccttctaaaatctcttgtcgatttttccaccattcgcgaacaggattaaagtgatcgtttctcattggtttagttttagagaaatttttatagccttctggcatatccaatctgtaaaaccaagtttcttctgtttttttcgtcttatcaaaaaagagaatattcgtatgaattcctgtatatggagcaaatacgctatgtggtaagcgaataatagtgtgaagattaaactcctcaaccaatttctgctttagtcgtgtttttactccttcaccaaagaggaatccatctggtagaattacaccaacacgaccattttctttaagtcgatacataataacagccataaacaaatctgctgtttcagagctgcgtaactctgctggaaaattattttttattgtttcaagttcagaaccaccaaatggaggattcatcatgatgatatcgaacttttcatcctcagtgtaatccctcacatttttttccaacgtattcccgtggatgattttcggatcatcaatttcatgcaagaataaatttgtcaccgctaataggtgggggaaagcctttttctcaataccaaaaactgcttgattgtatttttgaacgtcttcgctagtctttcgctgttggcctaaatgatttaaggtagatgtcaagaaaccacctgtcccacatgctaaatctgccatcgtttcccctaattgaggattgagcatttcagcaataaaatctgttgctgcacgtggtgtgtaaaattcaccagaatttcctgcactttgaatatctttgagaatcttctcataaatatcattaaatgagtgacgatcttctggactgttaaaatcaacttcgtcaatcacattaatcatttgccgcagaagaactccatttttcatatagttgttagcatcttcaaaagcagattttacaattgatttgcgaattggcatgtttggagtgatttcgagttctttcaactctttgaacaatttattattcacaaactcaagtaagtcatctccagtcaagacctgctcacccttctcagcatgagcccagtttcgccacttcaactcctcgggaataattgactcgtattcttcttcctccaactcccaatctaactctcgactgtcatagatttttaaaaatagcatccaagacatttgttcaattctctgggcatcaccatttatccctgcatcgtttcgagtaatatcttgtattcgtttaacaaatgatgtaattgacattttttcctctcattaagctacagcaaatagcttttcttctaattctttaattacttctaagtaatgttttctatttccaaaataggtattaacaatcttggaaggagtaccataaacatgaaattctggtaactttaaagtttcgatactttcaagctcaccgattcccttatccatatacttatctagtaaaacctctaatacagcacgcgcttcttcgctgtatttaaatagatatccactttgtttcacatttctgattcgctcggttttagtcaaacttttctgcccgtatgccagtttcaaaagtaaatcaaaatcatcgatttcttgctccgaaatattttctgcttcacgaattgcatccagatatacaccttttttatagagttcttctaaaataacttttttcttatctgctgaatgccatgcagtaataaaatcggttaatgtcgcatatgttcctaaaatatttttacgtgtataatctgttagactctcagttactaatttcccattttcatccaagacttgaactgtcgaattgagaatatccactttcctatccgcaactcgatatttttctataggatcacctactgtaaatgatgttgaatcctgtccagttttcagattaggatctaatattttcgccggctcaccatcaaatccaggatcagcaaatagatttgtcacattcctaaaatcaataatagtgaaaaactctttccctttttcaggatataaacgtgttccacgaccaataatctgtttaaattctgtcattgattgaatatttgaatctaatacaatcaatcgacaagtttttgcattaacacctgtggttaaaagtttagaagttgtcacaatcgccggaaacttagagttaacatccataaaattatctagttgggcttttccttcaggattgtcacctgtcacctgcataacataacgatagtcctcccgtaccaaatcctgattttcgttgacaaatgcttcacgcatacgttcggcatgatcaatatcaacacaaaatacaattgttttgtcaaagcgtgcattattttgtttcatataatctgaaacaaattttgcaacctttcgtgtacgatcatcaatgataattgtcttatcaaaatccttgcgaccataatacctatcttcgataagctgtcccttagcatcaacttttccattttccggacgatagccatctacgtccacatctagattgactcgcataactcgatatggagcgagaaatccatcctctatcccttgcttcaggctataagtataaattggctcaccaaaatactccatattggaaacttctttagtttcttttggtgtcgcagtcataccaatttgcgttgccgatgaaaaatactcaatcactttacgccaattactatcttcttttgctgaacctctatgagcttcatcaatcactatcaaatcaaagaaatttttatcaaatttttgatagtgagtttcggttccatcttctcccattaattgctgataaagacctaagtatatttcaaaagaatttaatttttctggcgcattcagcaattttgatgtgattttagtcatcactttttcaaatggcttgaaatcttctgccattgtttggtcaactaaaatattcctgtctgctaaaaacaagacacgctttgctaatccggctttcctaagtcggtgaataatttgaaaagccataaaggtttttccagtacctgttgccattacaaacatgactctgttttgcccgcttgcaactgcctcaattgtacgattaattgcaatttgctgataatagcgtggtttcttaatcgaaaaagcatctgtatagtaaggagttgttattgctttcgaaacctctggtgccatttctttttcagcctttaatcgctcaaataattcatcacgggttggaaactcttctaaagagagttccctctcttgtctagtaattcggtcatgctcaacaaacccatcaccatttgaggaataaacgaaaggaacatccaaaatttcaccatattcaatcgcttgttgtaaacctgcacgaatactatgcttattatccttagcttcaacgattgcaattcgctgtccaaattgataatagagagcgtaatctgatttttttccctcttttcgacgtcctttatcacctcgaacttctattcgaccatctgtgaaatattcttcataagcaatctgttctccatttttccagccttttgacaaaatagctggtgtaataaagtttgctttaatgtcttcttcactcatctcttttttagatttgataaatacaaccataattttcctctttcagtatgaataataacttcaggataataagattatcagaacaaactatatttctattataccacacctaaataatcaaactacaatattataataaagtaattctcaaagtaaacataaatatatttacatccccatccctcatctgtgcttttttcatcattccatgatacactaatagataagacaattttagaaagaaagatatatgattaccaaagaattcgacaccattaccgctatttccacccctctcggtgagggcgctatcgggattgtccgcctatctgggacggacgcttttgccattgccagcacggttttcaagggcaaggacttggcgactgtacccagccacagcctcaactacggtcatgccattgatcctgcaacgggtcaagtgctggacgaggttatgattggagccatgcgttctccaaagaccttcacccgcgaagatgtcatcgagattaacacccacggaggcatcgccgttaccaacgaaatcctccagctcctcattcgccaaggggctcgaatggctgagccgggtgaatttaccaagcgggcctttctcaatggtcgtgtggatttgacccaggccgaagccgtcatggatgttatccgcgctaagaccgacaaggccatgcataatgccgtccgccagcttgacggctccctctcccagctcatcaacgacacgcgccaggagattctcaacacactggctcaggtcgaggtcaacatcgactaccccgagtacgacgacgtcgaggaggcgacgacagagctggtccgtgagaagaccctccagttccaagctcttttggaaaatctcctccgcactgcccgccgtggaaaaatcctgcgtgaaggcatcgcaaccgctattatcggtcgtccaaatgtgggaaaatccagcctgctcaataacctcctccgcgaggaaaaagccatcgttacagacatcgcaggaacaacccgtgacgttatcgaagaatacgtcaacatcaagggcgtccccctcaagctgattgatacagcaggtatccgtgaaacagacgacatcgttgaaaaaattggtgtggaacggtccaaaaaagctcttgaggaggccgacctgatcctgctagtcctcaacgcatctgagcccctgaccgagcaagaccgcaatctcctagccatttccgatatggccaaccgcatcgtcctgctcaacaagaccgacctggaagagcagattgaagtagaccaactgcctgaggatgtcattcgcatttccgtcttgcaaaaccagaacatcgatcagattgaagaaaaaatcaatcaactcttctttgaaaatgctggtctggtagagcaagatgccacctacctctccaattctcgtcatatttccctcattgagcaagccgttcaaagcctacatgctgtcaatgacggactgaaagtgggcatgccagtagacttgttacaggttgacctgacacgctgttggcaaattttgggagaaataacaggtgatgctgctccagatgaactcattacccaactctttagccaattctgtcttggaaaataagaacaaaagtcatgtaagaaaacttgcatgactttatttgtatattaacacataatttcttgtctaagatgacaaatttagatatactaaacagtgaaaggcggcattcccatgaaaaaacttcttatttgtattgtccttctatcctgtcttgtctttccatttatcggctggaaactatatgcctatcagcacaatacgatcacattaacgtcggaagctgatttttacttgatttatcctggcaaggtcgagacttttcagctaaatgggcaagagcctcaactccttcatacacagaaaatgaattctcaagggtattttggctctggtgaaaattatgtcatagacaatcggtatctagtctttgccaacgatcagcaaaaattcattaacgacaatctgatatccatcgatttcaatactggcactgtcttgcgaaagccaagtcagtatagtagctatatcagtggtacagatggacaagacttttatacagtggggccctatcacatactagcgcaatttgacaggaattttgatactattcaaacccacgttttaaacgatgacttcatcccaagtgctccagtcatggtagaccaaacgtcagtctatttaactggttttgtgaaagattttacccaagaaggacccgaagaaaatgtcttgattgtatttgataagaaagatttttcaaaacaagaggtattcaagtacgacaataccattgccacaggagaagggctttgggtcaatggaaccatctatctcccaaatttagggaaaaaaacaagtgagtatacggaaattgaacagtcatccgaactcctaacctttgatacaaaaacaaaaacattttcgtcagtaactttagaacacccctcaccaagcacactacatgctctcaaagaccagaagcttctcctcatcgaacatcaaaatggtatgtttagcccgatctcatttaccatttataatacccaaacaggtcaagagagctaccatcgtctagacgagcttaatcctcgtccttattatattgaccatgtccgccaactagacggtaacagattattattgattctggctggtaaggcactcatctatgactggcaagcaaaaaaagttttaagccaaactattctatctgaggattatgttagcggggtgtgggtaaatgactgataaacaaaaacgaatctcaataaagattgtaaaagtcccaagatgactctttcttgggactttcgcatattctatcgaagttgcacagcacaatcaatgtacttataaatcctaggaaccactatctaatcgaagtaaacgccattcccaaagcagaaccaaaataatatttccacctttcttgctctaaatagcgcttaaacatctttaatttatccgattgaatcctattcaaagctagttcttccaatacccatggataaattttatacgaaagatagctaatcttactacctttttcacacaactccattgcttccaacaactggaatttcaatgctttgctcaactttaattctgaatcagataatagttcatttattttttgtataaacaacttactttttttactgtttctaaacattttcatcttcgtagggatttctgaaacaatcatgcgatggaaatgatggtgcaaacctactcagtcacccatctcttccaactgcttattatttttctttgtccccttccacttcttttgtttcttgggcagtcagtaaacctgttgacatggcacgaccagttagggttgcgctgattaaatcacggacattgagtcctagaccttctgttgtcttgtccatggtcgtcatcaggtctcccaccatttttgaggcattcccttcgccgtacatggtaatcttatcaacatttccaagtggtgctgcaatattcttggcgatttctggaagaacattaaccaccatttctgtcaccgctgcatcattaaacttagccatggcatccgccttcttgctgagtccttctgcctcggcttcgagtttcaaacggatggcttctgcttcggcacgtcctttggcctcaatacctgccgcttcttgctccgcagcatacttggcagcttctgcacgcgctttttgagcttccgcttcacgctgcgtttcgtagagttctgcttctgccttgcgttgacgttcaatcaaatctgcttctgcagcttgttggcgagcgtatttttctgcctctgcctgtttgcggatagtagctgagagctcttgttcacggaccttaacttcctctgcttttacttctgcttctttttgttgcttgacaatattggcttcagcagttgcacgctcgatttctttccgttgagcttgctcctcaatgccataggctgcgtttgcctgtgccagttggacatcggaccgacgttttagattagcttgctcaatagctagttcattctgtttcttggcgatttctaagtctgcagcaacacgcgcatcattagccgccttatcctcacgggcacggacttctgcttgttcccgctctgctttggcgcgagcatttgcggcatccttctggatggtcacaatattgtcaatacccaagtttttaatgacatcgttgtcatctgtgaaggattgaaccgtaaaggcaatgatttccagccccattttagccaagtcaggagctgcgttggattggactttttctgcaaaagcctggcggttattgaccatgtctcgcagttccatctgaccaatgatttcacgcagatttccttccaagacatcttgaatagaggcagaaatatctgcagttttccagttaaggaagttttgagctgccgcattgagcaattcatcggataccccaacctttacttttacgaccgcgtcagcttttacgttgataaaatcaagagtcggcacaaaatctgtggtctgcacatctgttgaaaactgctcaatagagatataggagcgtttttcgataaagggaatcataaaaccagaacgaccaattaaggtccgaggtttgcccaagccggtaatgacaatcgcttcgttaggcttagcagacacataaccaaatacaaacaataaaacaaatagtacaacaacaataattggtatcataattgccaatatatcaaatccaaagtccatatttatctcctttattccttatcactcaaatccacacttggcacggttgtcgccgcatcatttgttgcttggaagagctctactttttcatatccgaatagacctgcatagatggaggtcgggaaccgcttgatttttttattgtaggtagttgctaccgcattatagtctttacgggctaccagtatccgattttccgtaccttcaagctctgttatcaggtcagatacctgttggttggctgtcaattgaggataattctcagccactaccaacaatctagacactgccgaatccagctgactttgtgcctgattgtagtcgctggttcctacttgactggagccgattttagcacgcgcttctgcaatagcagtaaatatttcttcctcgtgttccatggcgcctttgacagctgcgactacattgggtatcaagtcatagcgacgttgcaactgtgtgtctacattggcttgcgcattttcaacctcagcataactgtcaactaagccattgtattgcccaactgctcccattcctaaaaacagcagagctaggactggaatgagaataaccaaccatctctttttcataagatttcctttctaactacgattaaacattcgtaaaaaagcaaacaactatcagaagccttatacgatgccttaccatccagaagaggctccgccaccgccgcctcctgaccaactacctccgccaaaactagacgatgaggaattagacgagtgatgattgtgatagtgatgatgatcatcaaccaacatccagagtagattgcctggacctccaccaccacgactagatttgtcaatgataccaaataggatagcgatcagaataactatgagaaacagccagaagccgtcatccttctcacttgtaccttcttctatagcagctaactgatttttaccaatgcttgtaccataaaatctatccccaatggagttgacgatataggaaattcctctactgtagtcttcctgtcgaaagaattcccttgcattctctaaaatatccttggcttccacatctgtcaacaccgttgcagcattgtctgaggtttctatccgaaatgctctgtcagctatggcaaccactaaaagaactccgttgtccgttcttgcaaaaccgacctgccagtgacgaaaggtttcattagccaaactttcaatatcactggacagactttctgttacataaacaccaacctgtaaagcttgctcggtgcttgcccaacttcgattgagttgatcaatttctgcaatggtctcactcgagagtaactgcgtctcatccactaccgttgtacctgtggggcggtctgggatctgatttgctctagctagtgtgggtgcaaatagcaagcaaaccgttagaatagcgaaacagccgatgataatttttttccattttctcatcagaacacctccttcgatgaacaaagataagaaaaatttattaggtatatatatacaattatatcatattatcattttcccaacaatatatttatgttgtttttcagtatcggtagagtctgttcaacaaaccaaggatgtttagcttgccagatattgtttctaggtgatggatggggcaaaggaaaataggtgggtaggtaatcatctgcatgtttcactctctccgtcaggttcctttgggatttttccaaataataagtttgagcataattgcctaccaatatggtcagctcaatctgggggagttgcttcataatgagtgggtgccatttgggcgcaaaatccttgcgaggcggcaaatccccagacttcccttttcctggataatagaaatccataggaagaatggcaaaatgacccgattcataaaaagtctgtcgatccacgcccaaccattgacgaaggttgctaccactggcgtcgtcaaataaacgccctttttcctgggttttcaagccaggtgcctgtccaataatgagaatttttgcggtcgaaggggcttggaaaaggggagctattcccttgttcgtaaaatctcggttagcaacatcctcaatgatggcttgacgaatatcagcaagttccatgatgtcctactttcttgactatggtcacatcttcttctaaggctcggaaaacgcattttttgtagaaagaataggctaaaaggttgcgttcggtttgcagaagaatatgaacaatctttctatcagctaactgcttctcaatatcagctaataaactagcaccatgtccttgcccttggtaatcacgggaaatacagaactcttcaattcgatactctgttccctcataccaatagcgaatgtaaccaagtgacagccctatcaatttttcttggtcaaacaagccaaaacagagtgctcttgagtgtcccagtaaatcgcctatgtagcaatctaattgttcctcatctgaccaatcatcattccaaggttcttggctgaaaacagataaaaataattctttaaccatttccatgtctgaaaaataaagttctttcagttccatatttcctcctaaaaaagacgggcgtacccgtcttcatgtattacttaatgagttcgtagatagcttctgcataaatggcagcggcgcggtagagttgctcaacttcgataaattcgttggcttggtgcatggtgttgacatcgcctgggaacatagctccgtaggcaaccccgcgtttgagcaagcgtccgaatgtaccacctccgataacttgttcgtgacctttcaagcctgtgtgtttttcataaacagacaagagggttgcgaccattgggtcatcgattgggcaataatgtggagtatggccatgctcagacaggctaacagcttccacgcccagtttttccaaaccagccttgatggtttcagggttggtattttttggataacggaagttgagggcaatggtattgtctgatgaagtttcgtcaaatttgaaaacaccagcgttcatagaaagagctcccatttgctcatcgtagatggctacgccgagttttttagcgtcatggtcttccagaaggacttgacctgccaaatccaaataggctttggctgcttcgtcaaaggcgaattggctgaggaattttgccaagtaggttgctccgttgaccccttcttctggggttgaaccgtgggctgattttccgatgacggtgacttgaacttgaccgttttcaagggtttccgcatcagcttttatgccataggctgctgtgaaatctactaacttgctgtccagatctgctaggtcgccagagataatagctgtcgcagattcaggcaccatgttctcacgcaggccgcctgtgaaggaatgcagtttagcagctccgctattttcccccgcaaaatgaagataagctgtgatattgcccttttctccgttgataatcgggaactcagcgtctggagagaatccgaaatctggcaggggaaggccgacgtgctcgaagtagtaatccatgtccgcccagcctgactcttcgtcggtaccgacgatgaagcggacttttttagaggtcgaaaggcccaactccttgatgattttcaagccgtagtagcaagccatggtcggtcccttgtcgtcagaagatccgcgggcaaagagcttgccgtcaatgatttgcggctcgtatggatcagtgttccaaccgcttcctgctggcaccacgtccaagtgaccgaagataccgaggacttcgtcaccctcgccaaattcaaagtgacctgcgtagttgtcaacgttcttggttggataaccatcacgctgagcaatttctagaaacttatccaaggcacgcactggtccaggtccaaatgggtgttgggcatctgcctggctatcgtcacgctcagaattgatgcggaggaggtcaaagaggtccgctagaaactcatctttgcgtttgtcaaactctgctctaaaatttactgtcatatgttctccttttcagtatcaaagtaagtctattttatcacaaaatgaaagagatttcacaagtaaagcgaagaaaaaaagttggtctcccaacttctttctattttttccaagcagatcgttctgctacaactgtaaacaaaacatcagttgatgagttgagggctgtttcacaagagtcctgaatcactccgaccacaaatccgactccaactacttgcatggctaactcatttggaataccaaaaagactacatgctactgggatgaggagaagcgaaccacctgctaccccagatgctcctgctgctgatagtgatgcaacaacggataaaagaagagctgagctgaaatcaacactaatgccaagtgtatgaacagctgccattgttaaaatattaatcgtaatagccgcgccagccatattaattgtggcaccgagcggaatggatactgagtatgtatctggatccactcctaaacgtttgcagagctgcatattgacagggatattagctgctgaacttcttgtaaaaaatgccgtaaccccactaactcgaagacattcaaataccagcgggtacggatttttcttcattacaagaaaagcaatcaagggattgacaacaagcgcgacaaaaatcatgcttccaaccaagagtaagagcagtaaaccatagtcttttaaagctgtcagaccattatttgcaatggtatcgaaaaccaagcccatgataccaaatggtgccagaccaataatccatcctacaactttagaaatcacttccgccgtagattgcaataaatcttttgttgtcttgcttgcatgacgaaaggccaagccaaacactgccgcccatgtcaaaacaccaatataattagccgttgcaagagcattgattggattgtcaacgaccttcaacaagaggtcttggaatacttcagcaatcccttgtggaggagtaatgtccgtagtcgttgtagtagaaagaaccagtttaatagggaataaatagcttgctcctacagcaatgaaggccgccgcaaaagtgccaaatagatacaagcaaataactgtcctcatattcgatttttgaccagcaggagcttgtgatagagcatgtgcaactagtgtcagaaccaaaagaggggctatagctttcaatgctcctacaaatagactaccaaagagagcaatgaccgttattttgggagcaattaagcctagtaacactcccaaaacaacaccaattccgatttttcggattaaattcatttttttccatacagatattattttattcactcatttacctccaaacaaacatttttcaatcatagcagaaaaatccagtcaggtcaatagccttggcttctaaaatctattttctgcatgatgcaatctatgtgtggcgcccatttttttacgaataaatatgcatctgtaatcaaaataaaatactttataagctttatctacttactgcccagacctcaacgatttacgcaatcattttgttacctaaacagctaactccactacttacttttatttcaaatgatagctaggtaacactgacctgtaatttttctttatgtgcgaaaaatgtgttaggattgcaatgaaaagccctgccttatcagtaaagcaggactttgatggctcaagaatatcgctagtaaatatcaatatttttgataccattcttatcaaataattgtgttttcatctccgtagtcaacggagtaataacgatttttgaattagaatcaatattggatacgacaccgataatgcgaccgtctacaacgacaggtgacccggattgccccttaacacctgtgatattggtttgaagcaaaccgtcataacggacttccgtaatggttccatattcgtattcccaacgtccgtagagattaatgctgttgctgaccattagaaattgtcggccaactaggtcataggtgttacggtaaattcctagccgagcatttgccgtattggctgtctgtgtttttctgctaggggtggtgattttcacaagggctacgtctcgactagcatcccatgttccaccatatcatggcatctgaatgaagggattgaagggattggttctcttaatttctgacagttcatagtatggtgaagcatcgccccaaacagcatttccagaccaagtttggctggtcacacgtccagtcccatcatctgccactacgtgaactgcggttaataaagtattcggagctattagaatagctgaacttttttggtttgaccggaaccaacatttacttccaaataatgagataaattatatggataactattgcgtagagctggatctgaaacgtgagtcgtctgtgcttcaacctctactattgtaggaggagctaccgatagaccgacactaagaagggctacgccaagcagtaatttcgttttcatttgaaaacctcttgttttttctttcattatatcaatcctaattataaagtgcaagcgtttccaagtgttttttgttcaacaatttaggctcttctcatccattgacaatagctcaaaaataggaccagtgcttatctaactagccctgttaaaatactttctgtcagaagtatttgcctaccactttatcgataaattcgctaggtaatctgaggcaaattgagtcaagcgattgcgactgtctttggattcataaaaatcaatcatggcaaaaccagctcgtaattgcccagcaatctgttcttctaaggtgtggctaaattcatagccatattctggatcaatcgtaatttgtcctgcttcttctaattgtcgtgcgttgaaaggcaggctgtactttggaaccaaggttttgtctggatgctcccaaacatcatcagcatcaaagacataaatccaagggttcatataaccgaccatgagcagaccaccttttttcaaaacccgataagactcctgccacatattggccaaatcttcgatataaatatttgaaaccggacaaaagatgatgtcaaaactctcgtcttcaaaaggaaaggcttgtgtcatatctgcctggaccgtttgcaaatccagattttctcgctcagcaactagcctatccttgtccaactgttccttggagaagtccaaaatagttgtctcatagctatgagccgcagaaattggtccctgttgaccaccaccacaggccaaacccagcaatttcttacctttggctttttcaaaccagtcaagcggtactgtctttccaaccgtcaaagaaacggataagggcttatctttggcaacaagaaattcctcatgactgagcggaactgtataggcatttccctgtctagctgaaacccgattccaacgttcttgattgtagtttacataatctgtcatttttctttcctcgcttgaggcctagccaatatgacctcgttctgttcttttcatttttcacctcctttactatgctaattctattatggcataaagaaagagaaaaagctacctatcgatagcttttagtctacgtcaagtcgttaaaatcccagacatcgtccacccagccttcatagaaatcaggctcgtggcagaccatgagaattgagcccttataggcttgaagggcacgtttgagttcatccttggcatccacatccaagtggttagtcggctcgtcgagaaccaggacattgttttcacggttcataagcaaacagaagcgaactttggcctgctcaccacctgaaagaacttgaatttggctttcgatatgcttggaagtcagaccacaacgagccaaggctgcccgcacttctgcttgattgagggctggaaaggcatcccaaacgacttccagtggggtctgacgattgccgccagctacttcttgttcaaaataaccgagttccagatactccccacgctccacagagccaccgagcggtggaataatccccagcaaacttttaagaagagtagatttaccgataccgttggcaccgacaatggcaatcttctggttgcgttcaaaggtcagattgagcggcttacgggtcaggacacggtcgtaaccaatctccaagtcagtcgtctggaagataaagcggcttggcgtccgagccattttgaaatcaaatgatggctttggtttctctgcttgaagttcaataatctccatcttgtccaatttcttctgacgggacatggccatgtttcgtgtcgcaactcgggccttattacggttaacgaagtcctgcaagtctgcgatttccttctgctggcgctcataggccgcctccaactgagcccgcttcatagcatgtacttcttggaattggtagtaatcccctgtgtaacgggttaagagttgattttccacatggtagacaatgtttatcacatcattcaggaaaggaatgtcatgcgaaatcaagacaaaggcattttcatagttctgcaagtagcgtttgagccagtcaatatgctctgcatccaagtagttggtcggctcatccagaagcaagatgtcaggcttttccaagagcaattttgcaagaagaactttagtccgttgtccccctgataactccgtaacatccttgtccatgccataatccatgacaccaagcgcacgcgccacttcgtcaatcttggcatcaagcgtatagaaatcacggctttccagacggtcttgcagctcaccaacctcttccatgagggcatccatatcggcaccctcttctgccatagacatgtaaatgtcattgatacgagcttctgtcttgaagagttcatcgaatgctgtccgcaagacatcacggactgattgacccttttctagtttagcatgctggtctaaataacctgccgttacataacgtgaccattcaaccttaccttcatctggctgcaattgacctgtcacgatggacatgaaggtcgatttcccttcaccatttgcaccgacaagtccgatatgttcccctttcaagagacggaaggagacattttcaaaaattgcgcggtcaccaaacccatgacttaaattctttacttctaaaatactcataatttcctcacaacatcaaagaactggagtaaccaaactccagtttttacttttattctcgcagtattgagcggaacttcttcgcctatcagctgtgaaattcctactcaaccttgcgggggttagacaacaaaatcaaactctacgagttactgatttctgtctaactcccaatttccgcacgaaccacatcggcaatggtgtccacgtagtaatcgacttcagcatccgttggcgcttctgccatgacacgcaagaggggctcagtaccacttgggcgaaccaagatacgaccgttgccagccatttctgcttccattttttcaatgatagctgcaatagcaggcacttccattgccttgtccttcatgctattttccacacgaatattgaccaatttttgtgggtaaatggtcacttctgctgccaattctgacaacttcttaccagtttctttcatgattttggtcaattgcacagcggtcaactggccgtcgcctgtggtgttataatccatcagaatcacatgtcctgactgctcaccaccgacattgtagccttccttgcgcatttcttcaaccacataacggtcaccaactgcggtcacagctttttcaatcccttcacggtccaaagccttatggaaaccaaggttagacataactgtggtcacaattgtatttttggccaatagacctcgatcagcaaggtatttaccaacgatgtacatgatgcggtcgccatctaccaaaacaccattttcatcgacggcaatcaagcggtcactgtcaccatcaaaggcaagtccaatttgactacctgtttctttgaccagttcttgcaatttttcaggatgagttgaaccaacaccctcattgatattcaaaccgtctggcttttcagccattactgtcaaatctgctcccaaatctacaaaaatttgacgtgcagatgttgcagcagcaccattagctgtatcaagtgcaactttcataccgtccaaatctgtaccagttgataccaagaattgctggtacttacgtagaccttctggatattctaccacatctcctaaaccttgagcagatgggcgtggcaatgtgtcttcctcagcgtcaagaagagcctcaatttccgcttccaatgcatcatccaatttgaaaccatcaccagcaaagaatttgataccgttatcttgcgctgggttatgacttgcagaaatcatgacacctgcacttgctttttcagttttgactaggtgggcaacacccggtgtcgccaaaactcccaatttatacacatgaatccctactgatagaagtcctgcaatcaaggcagcctctaacatttgacctgagatacgtgtgtcacgcgccacaaagacacgaggaacatctgtctcatgctggctaaggacataacctccaaaacgacccaatttgaatgctaattctggcgttaattctacgtttgcttctccacggactccgtccgtaccaaaatatttacccattttcataacctcttattttgtttttgtaagtataatttgcatatttgcttccgtctgagacagtacaactggcaagacattgccgtcgctatctacagcctgtaatttagctgtaccactataattctcagacagattgctcacatccatcgcaacagcttcgacccgatcaatcttagccattgtttcttcatccgttgtcactttaacggtatctacgttgactgaaaccttagacagactgtaaccttctgccaattgattactatagactcgacctgctactgggaatgccttgctaacttttttaccaatcttgacggtaatcgcatcaggtgctagtgtcgcactcactccagccggcaaattggtcaattgtagcttgacagtctgtgtcccatcactcaactctctcaaatccgcagtcacttgaaaagtccgagttgactcatctgattctctctgtaggagaacacgattagagccccttaattcaactgccaccgtcgaagaaaatccggaaataaaatacttgtttgtatcatattcaatctcaatcggtacattgctcagtgtgtgaacataggtttctgactccgtgttctgtgcagctgattctgaatttttatagttggtggttgttgcatagaaaaagagcaacaatgctagaaaaatagataaggctaagtgacctacagctttaaacttatcattcatgtttgccacctcctaatcgcttccagatggacttcttctctacattttcagaaataaaagtcgctcgcaactctgcttcaaactcatccaaagtcaaatcatgtttaaatatcccgtttcgtgcaatagagatactgccagtttcttcagaaacaataaatacaaacgcatcagatacctccgataagccaatggctgcacgatgtcgtgttccaaattcctttgaaattcctgcgctctctgacaggggcaaataagcacaagcaacagctaccttgtcttccttgacaattacagccccatcatgtagcggtgtattcgggatgaaaatatttattaacaattcctgagatatatccgcattgagtggaatccccgttgctctatattcttgcaatgtttgggcttgttctactgccacaagtgcaccaattttacgcggagacatataagcaaccgatttgagaaaagcaacaattaacttttcttctgcactcactgtatttgtcccaaaaatctgagttgttctaccgagtttttcaagcatagcgcgcaactctggtgcaaaaataactactgctgcaataaccccatacgtgattacttgattaatcagccaagcaatcgtctgcagaccgaataaactagctataatctgaacaataatgaagagaaaaacccctcgaatcaatgtcataattttagtacctgcaatagacttactaaaattataaatcaaataaacaactatactaatatcaattaggtgcaacagtgcggtccaaggactggctatcaaactcgaccaataccctgtatccagtaactggtttaggtttaacatatcattctcatactttctaactcatacatagtaatgtactcattataccatattttttccccttttctttagaaaatagtgaccttcctgttaaaaatattacagatttactgcaggaatatatcatgttccaacatactccattctagaaaatccccaacctttatgataaaatagtcccatgaaaataaatacagctttgggtattctagcaggaaaaagttcccagttcattttgaaaaaactaggacgtggtactaccctacctggaaaaattgccctcaaattcgataaacatattttagatagtttggctaaggattatgaagtcgttgttgtgacaggtactaacggaaagactctgaccaccgccctgacagttggtatcctccaagaagcctttggcgaaatcacgaccaataccagcggtgccaatatgatcacaggaattacggcaacctttttgtctgccaagaaaaataaaaacggcaagaagattgccgtcttggagattgacgaagcaagtcttgcccgtgtaaccgactttataaagcctagtctgattgtctttaccaatatcttccgtgaccagatggaccgctacggtgagatttataccacctaccagatgattttggacggggctgcaaaagctccgcaggcaactattttggccaatggtgatagtccacttttcaactcaacgaacgttatcaatccagtaaaatactacggttttgcgacggaagagcatgagccacgtctggcccattacaataccgaaggcgttctctgtcctcattgccaccagattatccagtacaagctcaatacctacgccaacttgggtagctacatctgtaccaactgtggctttagccgacctgaactggactacaagttgaccaaactaaaagaaatcaccaatacttcttctacctttgtcattgacggtcaggattataagattaacatcggaggcctctacaacatctacaatgccctagcagctgtcagcgtagcagaatttttcggcgtatctcctgaaaaaatcaaggcaggatttgacaaatcaaaggcagtcttcggtcgccaagaaacatttaagttgggtgataaagattgtacattggtcttgattaaaaaccctgtcggtgcaacccaggctattgaaatgatgaaactggctccatacgattttagcctgtccgtccttctcaatgccaactacgctgacggaattgataccagctggatttgggatgctgactttgaacaaatcacccaaatggacattccacaagtctttgcaggcggtgttcgttcgtctgaaattgcccgtcgcctccgtgtgactggctatcctgagaaccagattactgaaacaccaaaactagaagacatcatgaccttgattgagcaatcgagtagtcagcatgcttatattttagctacttatacagctatgctcgaattccgtgacctgctggctcaacgccaagccgttggaaaggagatgaaataatggtctatacgtcattaaaaagtcctgaaaaagactacacttacgatctccacatcgcccacctctacggtgatttgatgaacacctacggtgacaatggcaatatcctcatgcttaagtatgtggctgaaaagctgggggctcgtgtccaggtggacatcgtttccctgacagatgaatttgacaaaaatttctacgacatcgcctttttcggcggtggacaggactatgaacaatccattcttgctaaggatttaccgacaaaaaaagacagcctagcagactttatcgaaaacgatggcgtcatgctagctatctgcggtggcttccagttgctcggtcaatattatattgaagctggcggtcgcaagattgacggtctaggaatcatgggccactacaccctcaaccagaccaataaccgctacatcggtgacatcaaaattcacaatgatgagttcaacgaaacctactacggttttgaaaaccaccaagggcgtactttcctagctgacaaccaaaaaccgctgggcaaggttgtctacggcaatggcaataacaaggaagacggcggcgaaggtctgcactacaaaaacaccttcggtagctacttccacggaccaatcttatcccgcaatgccaacctggcctaccgcctggtcactactgccctccgcaaaaaatacggacaagacatccaacttgccagctacgccgacatcctcagcaaagaagtcgctgaagaatacggcgatgtaaaaagcaaggcagaatttgatactcaatgaaaatcagaatcagactaggcgacgcagatgcagatagaactgaagttcatcaaatcaagtcaacaacgtctgactttgattttcgaagagtatgagaaataaagcaaaaccgcttctgatatccagaggcggttttattttatatacttccaatcaaaagtaagccctccaccgttatctccgtcaattgactcaaatccagcttggactggtccacttggaaaaagaggggtgtcatgtctgccaaaatacgagcctgctctataccaatcggcagggtccggctgaccacctcttgctccacctgtcccatgtaagacttgaaatggtccacgatatcttggttgtcataggactccttgcggagttggtctttggctaaatggcggagctccttgaggtgattggggcctgggactagtttgagaatagccccaccagctttcagcactctggcaaattcctgataattggctggggagaagatgtccaagatcccgtcgatggtcttgtcttgaatgggcaacttggtcaagtcaccgacaaaccatttgaccgacttggtcctgtctgttctggctgctaggagaatagaatccttagaaatatcaaaagcaagaatgtccaagtccattttctcggctaatttacgggaataaaagccctctccacagccgatgtccaagacagaccgcaatcccagctctgctattttttcctccaaagcctcgtagagatgatcgtaatagcccgcctctaaaaaggcctgacggttttcaaagctagacttgtggtagttggcggactgcttgacctggggtgccaggttgacgtagccctgcttggcaatgtcgaaggtgtggcggttggggcagcgaaggctgttgaggtcaagaccaagagcctgcccacaatgtggacaggcgaaaaattggtcgctattggcaaaacgttggtgtttggtcatcttatttgtgttcttttctaaagcggtgcagggctagtcctgataggagcgtggcaagggctcctgtaaagaccagcaagtagccgactggaatgagataaaaattttcatgcagaatgccctcggcatcaatatactcgaccgagtttgccttgatgacaaagcagacgaagccgagaagcatgagaaaactaccaataatggtaatggtcaggtgcatctgggtacggcggccttcacgaccgtcttttacaagtttttctgtcatgttgttcatatcagttcctcctaagataagttgatctaaggagatcgaaaagacagaggacatgagaatcaagagctccaaatcaggtagattcttgtcattttcccagttggaaacagcctgcctggtcacattgagtttgagggcaaactgttcctgagtcaaacctttcttttttcgtaagtctttgatttgctgtccaaagttcatttctttctcctttctgggagcgggacagaactcgaaaaatgaaaaaaagttcgtcaacaatttttcgttttaagttgttgagctgaaacagtctatccccagactgtttcactcccacccccgcacagcttaaactgtctgggggacagtttaaggttgggaataaagcgaacaaagttcgcaacattcgttaggccagatttgaagtgtgcaacacgaacaaatctgccaatcaaccactgcgctgagatgttgacaccaccttcgagaagtgatgctaatctctatactgatcttagcttgtcggtcgatgttttccaagaaagactggcttgctctggacttttttagcgaaaagtggtcgttctaactccgcaagactggcttgcaagcttgttctatcaagggtttgagcctcttgtcaacttgctgtcaacctagcccatctgctcagataattcttcccattcttccatgagactttcttgttggctggtcagttggtcgatttctttctggtaatcggtcaactggccgatgtcgttggtttctagcatggcttggttgagctcgttcaggcggttttcgatgctatcgatttctgcctcgatttgctcgatgcggcgggctagtttgcgttgctctttttggttttccttttgggcttggtagtccatggctccagctgattggctggtactttctagctggtcaggctgggcttctgcttccagctctgcttttttctccaaataataatcatagtcgcccaaatagagcgtggagccagtttccgagatttccagcaccttggtggcgacgcggttgatgaaatagcggtcgtggctgacaaaaagcagggtgccgtcaaagtcgatgagggcattttccaagacctccttgctgtcgatatccaagtggttggtcggctcatcaaggatgaggaagttgttgttttccatggacagcttggcgaggagcagtcgggctttttccccacccgatagcatggaaacggactttttgacatcatctcctgagaaaaggaaagctccaaggcgattgcggatttccacttcaggtgtagtcggaaaggcggaccagagctcctctaagaccgtattggaaggtgtcagggccgactgggtctggtcatagtagcccacttccacattggcaccgagccaggcttcccctttgataaatggcagagctccgacgatggatttgagcagggttgtttttccgattccattcggaccgacaatggcaatggcatcgagtttccgttggtcaatagaaatgggctgggaaagaatgtttccatcgtaacccaccgcagcattttccactgtcaagacgatattgccagaagtcttgtccgactggaaggtcatattggcagacttctgaccagttgtcggcttgtccaatcgatccatcttttccaactgcttgcgtctagcctgagcgcgcttggtggtcgaagcacggacaatatttttctggacaaagtcttctagtttggcaatttccttctgctgcttttcatagttttgcaattctgtttgtaacttctgctctttgagctcaacaaactgagaataattgcccacatagcgatccaaggaatgcttggtcaaatccagtgtcagtgtcgccaccttgtccaagaaatagcggtcatggctgacaataatcaaagctcccttgtaatgcactaggtagttttccagccaagcaatcgtgtcgatgtctaggtggttggtcggctcgtccaggaccaataactctgggctttcaagaagcatttttgccagagcaagtcgagtattctgaccacctgagagttcggagatcttcatgtcccacatggtctggtcaaacttgaaaccattcaaaatagcacggatgtctgcctcatagctaaaaccacctgccagacgaaattcctccgacagactatcataggtcttcatgagctggtcgagttcattaccagaaagactgcccatttgctcttccatagatcgcaggcgtttctccgtcatccgcagatcgtcaaagacatggagcatttcatcgtaaatggtattttccgactcaaaacagctgtcctgtgccaggtaagaaagggacaaatctcgcttggtagaaatctcgccgctagtcgctgcttcttctccgacaaggattttaagcaaggtggacttacctgccccattttttccgacaagagcaatccgatcccgctcatccacttgaatgttgatattgttaaataaaacttcgcccgcaaatgagcgttcaatcttgtttccacttaaaataatcataaaaatattgtaccataatttagggtaacagtgcggaatcctttttctgatttcagcaaaaaacagcgactttaccgtcactgtccttctcaaaaaatatttagaccaaaccgctaagcaattccttattctgccagagtagataaagaccaccgccgataataatcagcataatgacaaacttaatcaagcccttaacaaagcggatgaccaacatcaatatcatagatacaatcagccatccccaagcagaagaattgagtaaggtttgcatactctctagacttgcacctgtccaggccttaattggttcagggattttatcaaaccagttgctatctataccgatttgttccataatcgaatgactggtagactgcatccatgcaaaaattccagcattatagagaaagagcagagcttgctcaggataacgttttattgtgtttgtaattgttcgaagcatattttcccttctattctgaatacaaggcaaggaccgcatcaatatctgcctgctggataccatgattagaacctgccgattccataacagaggtctgactatcttcatgatctaggccaatagcatggcccaattcatgctcagctgtatggataattctatccatatcataaccatattggtcgtttaataaataaaaactattcagacacaccgttaccgagctataataattcgtcaataaattagtcgttgaattggcctcacctgctgcctgggtatttccatcattcatctcagtagcaataatatcagcctgatttggatcacttgtcatcacaaaagtaaatgcccctgtcgcattccaatttgcaatggctgtttcataggcagctacaaatgttggattctgagtttcaatgtaaacagtcgcagtattgctttcccatcgaccatgatcggctgtattgaccgtatcagtcgtcacttcagactgtcctttaaccatcagttgcacttcttgaggtagagtttgtaacatctgaggcgctgcttcctgttgaaaatagaataatagacctagaccacaagccaataacaccattgataaccaaatcagaccccaaaatgtccgccaaatccaccgtagaatatttccaataagtttcatagactatacctctttctagaaataggttttagtatagccataatttctgaaacttttcttaaaaactaggacaatctttcttccaatttgaaatcaattggcaaccaagccaatactttctcaatctgctgattccagtagtaccactcatgtttaccaggtccgaaacttgcctctatatcaaatcccagctctttcaactcctcaactgccttttgatgcccttcaaagagaaaatcttcctcaccacaccaggcataaaatttggtctttttatcggattgtttagcaatttctaacaaattatttggattctgtttatcagaaatatcaccaaatactccttgccaatacgaaagacttcccaattctgctgccgctggattatcaaaatcaaaatacaatgcgcctgaaagcgaagctgcgtgtgaaaagcgattggtcatcatggcaatcttgaaagtcccatatccccccatagacaaaccagcaatgaaattcttctcccgcttgtcagacatatttgggaaaaaccgcttgaggatttgaggcaactcaatcgctatggcatcataataattcataccataggtggtattggtgtaccaagccttatccgtattaaccataacaacaatcaaattagtataacgaaccaagcgttcaattgtagaccgattgagccaggaatcctggtttcctcccataccgtgcaaaagatataggacaggaatgtcgttgtcatcgggattttccacacgatttcgatctggatataaaaccgtaacctgtctagacatatctagagcttctgagtggtattcaattttcattattgccataaatcttctccttatggtaaagagcctgagtttccctcggctcttcttatgtatataaatcagcttacttgacttccataatcaccggcaaaatagctgggcgacgtttggtttggtcaaagaggaattttgctaaatcatcgcgaacagcactcttaagctctgcccagtcaaagctatcctttgtaaagtaattttccaccgttgtattcaccaattctgatgcctcacgcaagatgtccttgctctttttcacgtagacaaaaccacgagtattgaccttggctttagaaatgatttttttctcacggcggttgacagtgatagccacgataaagataccgtcttctgagaggatcttacggtcacgaaggacgatatttccaacatcgcccatggcatttccgtcaatcatgacatcaccagccggaaccgctccgctatggacaaaatccccctcttcaaaagccatgacatccccacgcttaacgatgataatgttttctggatacataccgatttcaagcgcagccttagcgtgagcatccaattgacgatactccccttgaactgggaaaagatatttaggcttcatgatgttgagcatgagctgcaaatcacgcgcattcccatgcccagagacgcgaagattctttgtgatagattttacggtaccaccagccttgtaaatcaagttctccacacgagcaacaaccgcttcttttgaaatacttggagtggtaacaatataaactagatcaccttctttgatttcaacatagcgatgtctaccgatagacattttacgcaatccatttaacggctcgcccatacgaccagtttctaaaataatcaattcatggtcttcatacttgttcatatcctttggttttaccaacaagcgttcgctgaccaaacgaagttttttcaattgaatcgctgttcggacaatgttttccacatcatgtcctgtcaatacgacacgacgaccagttgcttctgccgcgtcaaaaatctgttgaatacgtacaatattgctggcaactgctgccacaataacacgcccgtcacagtcagcaatcgtattgagaatttcctccccagcctcatgcatgctcgctacttgaacattgctatctgcattagctgagtctgacaagagggccaacacaccttcgttaccgatttcagccaatcgcccaaaatccgtacgataaaacttatctgccgcctggtcaaacttaaagtcacctgtgtagacaatatttccttcatccgtcttaacgacaattcctaaactctctggaatagagtgggtcgtctgaaagaaagataccactgaatccccgaaatcaatttccgtttcagcattgataacatggaaatcattaaatttcttagtagcattattccccttgacaagtagcttagccaattcgatagtcaagtgcgaaccaaatactggcactttcactttctccaagagataaggaagcgctccgatagcatctgcatgcccgtgagataaaaagacccctgctacacgatgcttattttcttccaaataatcgaaatttgggacgactacatccacacctaactgttcattctcaggatactttgcccctgcatccaaaacaaaaatatgttcattcacttcggcaatgtacaggttttttccattttcccgcacacccccaagagccataattttaattgtactcatctttactccttttggacatcccacaggtgtccattttatttttcttaccaacggtccttgggagctccaagtcgaattacagtctgctatttatcgtcatttagtttttcttttattacttcgacgtaagaggaaactccgtttccttatttctaacttcaaacactccactggactgtttgaactcgccttgcctgattgaaacagtctgggggactgtttcaagtcaatgcctagaaacaagaaaacattgagtcatgcctgcagctcgttgcctagtactaaaagtaaactaaaagactatattttagctatcgcttctattatacattttttcaagaaaatttacaaaaaactccgctgaaaatcaacgaagttctacatatacattagtaaccatgtcccttatgttcccacttaccaccaacattccgcactaaaatccatttccaatccgtatgagtactattaggctctaaggtgggctctgccccctcagctgctaccttaaaagacgaagttaggataatagcttcctctgcaccatagtgctccgcccactcatcaaattccttttcattatcaccactgtaaccgatagtcagcaatttacaactgttaaaatggtgatcaaagtaatcttgaactacaagaatagccgcctcaatctctttttccgtatacaattctgattgttccatcggttcaatctctgcctgataagctgctcctgtccgacatcctaccaaaaaaaggcaacacaacagactacaaatagctaaacattttctcatctttgttacccccagtcaacaatcgttgctgaaaagccaatctcttcgacaaaacgtaatacatcctccgttttgacaaaaattgttttcgtattaacattggggtggaaggttagaatgggttcggataggatttctttatcaaaaaagacttgaatatccttatcaacattatgtaacaagccaaaaacagataccgcacccgcaggcaagtgcattttttccatcaagctatcactcgaggccatccgaatgcggttggctcccaccaaatcacgaaattggtccatatccagctgcttctggtcatccatgatcagtaaataaaatgcagtctttttcttattagtcagaaacatggacttggtccgtactccttctaccccttcaatgtaacggtctgcttcctcagttgtcagagctggtggatgctctacaatggtgtagtccattcctaagtcagctaagctttcaaaaaccaatttatccatgacagcacctcttgatatatttagtatattatactgctttttaactaaaaattcaaaggataataaaagcctggattactccagactttagacctgtattcacaagtgatctgtttgatataagattcagttttagccaaaaccaaacttagttggaagttgcgaactatccacacaggttcttaatcaaacaacttataataatcttccagtttcatcttggatttttcttcagccgtttggtcctgaataatctgaccatttttcatgacaatcaagcgattaccgtgacgcagagcatcttccatctggtgagtgaccatgagggccgtcattcccttggtctcaatcaactcgtccgttaattgcatcaaggattggctggtcttagggtcaagggctgcagtatgctcatccaagagtaaaagttcaggctgtttcaaactcgccatcaacaaactcaatgcctgacgttgaccacctgataaaagtcctgctggcgtgtccagatgtttttctagaccatttcccactctcggcaaaagctgggcaaattcttccgtctgttgggccaatctgcgtggcagtaagccccgtccctcgccacggtacttagctatcagtagattttctgccaccgtcatccgtggcgctgtacccattttaggatcttggaaaacacgtgacaaatacttagcacgtttttctgcaggccaattggtcacgtcctcaccaagaatatggactgaaccactagtcaagggtagggttccagcaatgacattaaagagggttgacttcccagccccattgccacctaaaatggtaataaaatcaccctggtagatggtcagattgacattgtccaaaatcacacgttcttcatcaaaaccgtttgtcaccaccttggtggcattttttaattcaacaattgctttcatcgtgacagactggctcctttcagaagtttatttttcaactcaggaaccatgaggcaagttgccagaatcatggccgagaaaatacggaggtagctggtattgatcccgagggaaatgaccaccaaaattaagaactgatagaaaatcgctccgacaacaatggccaagaatcgttctaacatagtaaggttaccataaattacctcaccgataatcagactagccataccgaccacaatgactccaataccacgcgacacatccgcatagccttcttgttgtgcaatcaaggcacctgcaagagcgatgatcccatttgaaagaacaaggcctagcaactccattcgacttgtattgataccaaaactgcgtgccatatctggattatcccctgttgcaataaaggcctgtccaaggcgagtatagaggaagaacatcaaggcaccaatcaccaccgctaggctacctagacctagcaagagaccattgacttgctcagaaaaaggaaggaaatcttgtaaacgtttggtattcagtaagcctagatttgccctacccatgataaatagaatgacagagtgacaggaagacatgaccaagataccagctagaagagtgggaattttccccttggtataaagcaagcctgtgacaaagcccgccaaacagccaacaagaactgctgctagagtagccaagataggatgaactccttgcgtcaataaggtaacagcaaccgctcctccaagcgggaaagacccctctgtcgtcatatcaggaaaattcagaatccgaaaggtaacgaatattcccaaacctagtacagcccataaaagagcctgtgaaactgttgatacaatcatatttttccttttctcttatctcttattcgataaccttgcttgctttactaatcacatcatctgacaaggtaattcctaattctttagcaactttttggttgacaacaacggtaccctcgttaaagatttgtacaggtgtatccgctggattggcaccatcaagaattttcgcagccatcttaccagttgccacacccaagtcatattggctaagggtaacagatgcgatacctccaccttctaccatgtcttctacgctagtgaaaatcggagttttggttttatttgccacagatacgacagttgaaaatgctgaggcaactgtgttgtctactggtgtaaagagaacatctgctttactacttgcgacctctactgtcgctgcaatttcattactagaagcaactgcatattcaagaacagtatagccagcctcttctgctgctgccttaaattccgctacttgaatttttgaattgtcctcatttgaagaatagaggacaccgatagttttagcgtctggtgtaatttctttaatgagagaaactgcgtctgctactggtgtttggtcagatacccctgtaatatttccaccaggatttttcaaatccgtcaccaggttggctccgactggatctgttacagcccccatgataatgggtaattctgtggttgcattggcaagaccttgtgcagcaggtgttgcgataccaatcaataattcattgccattgtccaccaattttttactcatggtttgaacttgggattgatcaccctcagcattcataaaatcaatttctaaattatccgttgtggtataaccaccttcttcaagtcctgccttgattcccttataaatctcatctagtgaatcatgggttacaaactgaagaacccctatcttaactttctccgttgatgtagatgaattgttctgctctttctgtgtcataaacaaagcagcaactaccataacagtaagggcaacaattgtagcaagtaaatttttatttttcaacatattcattctcctcgtaaaatacacaatatacaatttctacgtcatcaatatattatcccaccatcgccatcgtttcatcatgattacctcgttttgttaataattgtcaaagtagattgcttttagataaggaacggaggcgcagacataactcaagttaggcaagccgaacgtgacgcaatataaaagcactctacgaagacaatggaaaagcccccgcaggaaaaaacaacctgcgagggcgtcaatgacacggtgccacctcacttatgggaattgtctagaatcctcccatatctcatctcctctaacaaggagttgcactgtaaggtgtgcggaccgaactatcattgttttaagttcatttacgtgactgttttggctagttacttcgttaactctccttgctataccgccagtataagctgcgtcgacctgcctcgtactcagccaaaacagtctacgcaaagtatgctataccaaacaatccttgtgaatttagggcattttaggactaggcagtcgggtgaaggcagtactggtggtacggcaagcacgactaacgacgtcataaaatagacataaatgcacatcagcccatttcataaaactccgccacccgttctcagcaccacaggctccctgaagacttctgctttactacttcttctgattacagatgattatacggtatccatcagtctttgtcaatacttttgattaaattttctgaaaactttttaataccttaagagtctattttgagctattgctcaggatactgccattggattgaataacttctttataccagtaaaatgatttctttctatatctagttagactgccacttccatcatcatttctatcaacataaattagtccatatcttttagataattgtgcggtagacatagatacacaatcaatacagccccaagaagtataacccatgacttctacgccatcctgtatcgcctccgcaacttgtaaaaggtgttcttgcatgtattgaattcgataatcgtcatgaacagtcaaaccaccagcctcatccttgactagctgatctttagctcccaaaccattttcaacaatgaataaaggaatctggtatcgattataataacgatttagtgtcaatcttaaaccaattggatcaatctgccaaccccaatcagaagcttctaaataaggattgaccaaaccacccaagatatttccttttccagatgaatattttgatggatctgctgcctgagtaatactcatataataactgaaggagagaaaatcaaccgtattattttttaataactcttcatcaccttccacgaaagtaatctttatgccattttctttaaagtatcttttggcataattaggataatatcctctaacatgtatatccgaaaataaatagttcaaattttcataggcatgagccgcccaaacatcttcaggattgggtgtcattggataggtcggcatagctaagaccatacagccaaccttacagtcaggaataatttcatgagcaattttggtaacaagactagaagctacaagttcatggtgaatggcctgatataaatcttgttttgaaagttcttcattcggcaagtcaattccaccacttgtaaaaggcaattctaagacagaattgacctcgttaaatgtcaaccagtacttaaccttatctttgtatcgctcaaaaactgtacgagcaaatttttcaaaaaattgaatcatttttctatccacccagccatgatatttccttgccagatacaggggagtttcatagtgagaaagagttacaagaggctctataccattctttagaagttcatcaaaaagttcatcataaaactgtagcccttcttcatttggaaattcttcatctccattcggaaatattctactccaagcaattgatgttctaaataccttaaatcccaactctgaaaacagggctatatcttccttgtatcgatggtaaaaatcaatagcttgtaatttcaaattatcctccgttggttcttgggtagcttcacccagtccaccattggggagaacatcttgaacggataatccttttcctccctcattatatgcaccttctacttggtttgcagctactgctcctccccataagaaattatctggaaaaattgacatataccctcctcgaattataagactgctaataaatcatcagcatagttgacttcctcttttgtcgaaagcaagagaacatccagatattcctgtgtatttgtaacaactacaggagtcactatatcgtacccttctgcgacaagcatttctacatccacttccagcatcagttgacccttttcaactttttccccatctgaaacatggcttacaaaacctcttccttttagctcgacagtttctaatccaaagtggataagcaactctaccccttcatcacttgttaaaccgattgcatgttttgttggaaaaagactggtaacagtcccgtcaaatggagcatagacttttccatccttagggataattgcaactccttctccaagcattttttttgaaaacgttgcatcatttactttttctaaagggagaatttgacctgaaagaggagagaagacattttttctacttgaaatgccaggtgctactttttctaaattaactgttgacgtttcttcatcaatacctaggaaataggccaaaataaatgtgacaataattgaaattgccgcagcaatcatagcattagtaatgtttgaagctgcttcagagtaaataaattgtggcaaagcaatgagagaaggtactgcaaagaggtatgcttttacacctgtcaaaccaacaaataatcctgctagaccaccaccaatcattgctgcatacaatggttttttatactttagagtaacaccatataaagcaggctcagtgacaccagcaaataaagctgaaaatccagctgcaaaggctatttgttttgtgttactatttttactcttaaatgcaactgcgatagaagcggcaccttgtgccaagttagaacctaacatcgctggtagaatcaatacatcaggtgtcgcgattgaagctgccaagaaaatcggtgcaaaagcccagtgcataccggtcataacgataaatggcatgattgctccaagaactgctaaagttaaccaaccagctacaccatgcatttgttcaaccaattgcgataatccttcaccaacaataacgccgagaggtccaacaagaactaaagctatgaaacctgaaacaagcaggaccaaggttggctgtaagaaacttttcgttacagctggagtgaccttgttaaaaacagcttcaatatacttcattagccaaaccataataagaattggaataactgatgaaccatagctagcaggtgtaacaggggcacctaaaaaatgaagtggatcacctgaagataccatttgaacaaaattaggatgtagcaaaataccagcaaccgacatagctaaagcaggtgtaactttgagtttttgtgaagctgagtaggccaaaaaaatcggcataaagtgatatggtgcatctccaaaaaaggctaaaaatgaaattgattgggaatccgcttttaaaagccccagcatcggtaagacaatgactagaacttttatcatacctccaccaagcatagctggaataagtggtgtcatagagccagcgatatactcgatgacttgttctaagacatttgcttttttaagctgttgaactgaatcagaatcaaattttcctaatgcagtaaattctttatagtaattagctacatcattacctaagatgatttgatattgtccattttttttcataatgccaatgactccggaaatggatttaacacgttcatcggacacgatattctcatctttcagttccagtcgcaatctagtaacgcaatgggttgcacgaagaacattcttttctcctccgactgcccctaggattgccaatgcagtattcttgtacttcataatagactccttatgataaattttttgttaaacgccgaatgtgagcaattaaatagactaattcacttggactcagtagataatcatattctaaccgaataaagtccgctactcgagttccacattggtactctcttggatacttctttttcattaactctaaaagatccacatcatcttcatcatggtattcattcccctctaccaaacgatgagcaaacaacttaacatgtgtgatgaatcggtagtaatcaatagaatcttgattgaattctgtagaataatagtcttgaataatttgttcaatcttcatgataattccagtaatacgataagattcttgaaaaatattttccaaattcgcattgacaaaatgcaaagcgatgaaggctgcttcatcaactgggagttcgacatgtaaatctttttttatgatggataatgcttttttccccagttcaaactcctctttataatatttggcaatttcccatctaagagggttcgtaacgactactccttccttatgtctttctatactagaattgatatgatctgtcaaattgatgtaaataatctcatcaaaatgatttccaagtgttatctttcctaaatttattattttctcacaaacataaaccaactcaataggaacatcgataaatagttccgtaaagcgattcatattatcgctattcttgagcaaaaaacttttttctatcgaagaaggtgggatcgcatctccgaccttctttccaaatgcaattcctttaccaaacaacaagatatcaacgttcttattattttgtgctatgactgcattatgatttaatacacgctttatgatcataaattttcctttaaacttaaaataaaagaacctacttaaaagaaatcgacatatatcgtatcgattcatttaaataggttcctgctcgccttaaagcgataacatccttttatttcaattattagttggtacttctagcttaaaaaatttaataactctgtaaccattttcaattttaatataaattaaagaatttgtcaataatttataaaaatataagaatacttcttttagtccccttcgttaaaaagtcactgatttatgatatactagactgagttatagctattagaaagaggaaaactatgtcttttgacggattttttttacatcacatgacggctgagttaagggccaatttagaaggtgggcggattcagaaaatcaaccagccctttgaacaagagattgtcctcaacatccgcagcaaccgtcagagccataaattgcttctgtccgcccattcggttttcggtcgggttcagctgacccagtcggactttaccaatccaaaagtgcccaatacctttaccatgattctgcggaaatacttgcagggagccattatcgaggagattcgtcagttggacaatgaccgtatcttagaattttcggtgtccaacaaggacgagattggcgaccatatccaagcaaccttgattgtggaaatcatgggcaagcacagcaatatcatcttggtagataagtctgaacagaagattattgaggctatcaagcacgttggtttctcgcaaaattcctaccgaaccatcttgccaggctccacctatattcgtccaccggagacgcattctctcaatccttatacggtgtctgacgagaaattgtttgaaatcttatcgactcaggaactgagtccaaaaaatctccaacaggtctttcaaggtttgggtcgggatacggcttctgaactggccaatcatttgcagatagaccgcctgaagaacttccgtgccttttttgaccaggcaactcagcctagcctgacagacaaatcctatgctgctctgccatttgccaatagccctgaaaaccagccacactttgagagcctgagcagtctgctggacttctactatcaggataaggcggagcgggatcgggtggcccagcaggccaatgagctgatcaagcgggtagccagtgagttggagaaaaatcgcaagaaactaatcaagcaggagcaggaattggcggatacggagacggcggagttggtgcggcaaaagggcgagctcctgaccacctatctgcatcaagtgccaaatgaccagtcgagtgtgcggttagacaactactatacgggcaaggaactggagattgagttggatgtggctttgactcctagccaaaatgcccagcggtacttcaagaagtaccagaaactcaaggaggcggtcaagcacctgaccaacttgattgaggagaccaagtcgaccattgtctatctggagtccgttgacaccatgctgggacaggctagtctggcagaaatcgatgaaatccgtgaggaattgattgaaacaggctacctcaaacgccgtcatcgtgagaaaatccataagcgtcagaaacctgaacgttacttggcaacagacgggaaaaccatcattctggtaggaaaaaataacctgcaaaatgatgagttgaccttcaaaatggccaaaaaaggcgaactctggttccatgccaaagacattcctggtagtcatgtggtcatcacagataacttggacccaagtgacgaggtcaagacagacgcagctgaattagctgcctacttctccaaggccagacattccaatctggtccaagtcgacatgattgaagccaaaaaactccataagccaacaggtggcaaaccaggctttgtgacctaccgaggtcagaagaccctccgtgtcaccccaactgaagataaaataaaatccatgaaaatctagttcatggatttttctgtattgaagcctactccgccttatcaatatcttctctaacttccttagcattgaacttagcaaaaagatattggcggtcttggactgggaagcgttggtctagttgatctactggccccacttccaccattccttctgagataacataatccatgacatgcccgccaaatgtcaaatcatccgaaataaaatgcaaatgatagccagccacactgaccccgtgaaaaatttctggtgtccaaataccaacaatggtacctgaaatattctcagcggtatactcaggctgacgacttgccacctccgcaaaacgaacatcagaagccgattttggaatcatgcggacatgcatccgtgaaaacgtccctttgattttgatggagcgaaaaagattttccccatcataataggattcaatccgctgatgcaattcatcgctggtcatttcaaagcgttgcttaaaaatcacttctgcttcatggaaaatgaccgctgcataaggaaccttcatctcagcaggaacttcaaccacttctggtttctcccctgctcccttggcctgataagcctttccatccaagacaatcagctcgccatcaatggaatccagggttcccaagcccaaatcaccatgttccaacaattcgccaaccgtcaaggagccgccatacagtccagccattaaggcacctaaggtattgtattgaaataatcgatttacttgcataacctactcttcattcaaaaattcttgcatggctaaatcgtctggcaccaattggatataacgactagcttgctcttttgcctcatccaaacgaccaagttgacgtaaaaccgctacgtaatcagccaaaaattcaggattctcagcaaattctccagccaattcatcgtaaagctcaatagcttcatcgtctctttctagagcttgataagccttggccacattccagcgagctagaacgttatctacctcttcatcaaataaagccacaacctcttcaaatcgttcctgctcaagatacagattggacaagcgcagagctagttcgttactatcatctgctacctcttttgcccgtagaagataatcttctgcccccgcctcatcatgcaattcataggcatactgagaagcctggagcaagagattggcgtcaaaatcatttttagccaggcctttttgagtcataaccaaggcatcatcaatcttatgctcgacatgaagcgactgagcataggcatattcatagccctcaaaatcaggattgatggtatccaactgcttgaaatagagatttgctttttggtattcttctcgttcaaatagcagagctgctaactcaaaaaccgtctgatcatcgtattccaactcaacagctttttccaaaaattcaatcgccgcttcaaatttccccaaacttgcataggcaataccaattcgctgataggtagaaactcccgttaattcgtagatctcacgattatccagctgggcatagtaggaaatagcctcattaaaaagctccagttccatatccaattctgctaagccaaagaggatgatgggttcatctgataagtgacttgcttctaacaatttttcacgcgccacatccgacaagccttctgcctgatacaggtccgccttaaccaacaaggcttccacatagacagaactgtcttccgaaatttcctccaagtatccaaaagattcttcaaccaagccatcttcaaatgctatttgggcaagattgatcagtacttcgggaaattcttctttgacctgctcatagatttgtctagcctgtgggaaaaaaccaatgccttctaagtaggctgccaaggacaaaagcgtttcgctatcatcttgcaccaaggcgcgcttgaaatacttatctgccttgtctaaatcctgttggtccaaacaaaccaacattttttcactattgttcattcacaacctcattttcttcatcttcatacaaaccactgtgtgccttgtaccattcaaatgccgctttcactaaaaccttaatagaggcatatattggaattcccagaagaactcctaggacaccatacatctgaccagctgtcaataatacaaacaaaatggtaatcggatgaatacttagggagcttccgataatcaatggtgtcacaaaacgaccttctatagtttgctcaatcataaagactactaaaacctttatcagcatgattggaccagcaatcaatcctaaaataacagctggaatcatggccaagaaagaacccaaatacggaattagattgaggaaaccagccatcacccccaaagttattggatagctaagaccaatgattgagaacatcactgaaaacatcagggcaacaataatcgcaacggtcacctgaccacgaacatagtttgataattgcccattcacatctgatagtactgttccaatcggttctctccacttggttggtagatattgggtgatgtgtttattcaaatactgaccatcccgtaatagataaaagagaataaagggcataatcaaaatagcaacaataatctgtgaagcggttgaaatcaaattacttgcccagttcacagcgcttgaagaaaacttctgagcataggcaacgatctgatcattgaccttatttaacatctccagagctgttggtctaaattgttcaaagcgctgatcctgtaggagcccagttacctgtccttcgattttctggatattcgaaggaagattttgcgcaaaagatgtcacttgctcttgaatactcggaattgccaccgccagtccccagataatgagaagactgattaaaacaaagagaatggaaataccaactgtacgagaaattttatgcttttccatccagtcaaccatcggatttaataggtaatacaaaagacctgttaaaatcatcggtaacaatacaatttctaaaaagcttcctattggtctgaataaaaaactaattttactaaaaataaatatggtcaaaaaagtcagcaaggttaccaataaaaatgtcaccgcttggctatttaaaaacaagcggaaaaaccaagtcagactaaatttttgatgcttatcctccatctgatacactcctagtctttttttctattgtaacatggagaaaggatttttgtaaaaatcaactacagaatctatacgactttctcagaaaaacatggtataattttatcaatcatttccaaaaaggagaatcctatggctatctatttcggtacctatacaaaacgtgaatcaaaaggaatttataaagcaaattttgactctgaaacaggacaacttagcaatctagaattggtcactgaagaacctaaccctacctaccttgcctttgataaggccggacatctatactccgtcggcgctgaaaatggtctaggaggtatcgctgcctttaatactgactatactctactcaaccatgttgtatcagagggcgcaccactttgctatgtcgctgtagatgaagcaagagatttagtttatggttccaatttccacaaagggcaactacttgtttataaacgtttggcggatggttcgctagaattagctgatgtcgctcaacacgaaggatctgggccgcacgaaaaccaagcttccgcccacgttcacttttctgatttgacgcccgataaatttttagtaacctgtgatttaggatgtgatcaagtggtaacctataaggtatctgaccaaggaaaagtagagaaaatagcaacctatcaggctgcgccaggaagtggtccacgtcacattgtcttccatactgtcgcaaaaatcgcctatctcatctgtgaactcaattcaactattgaggtgcttatctacgacggctggggacaatttgaacacctacaaactgtctctactctcccagaagaccatactggtttcaacggtactgccgctattcgcatcacaaaggatggtaaatttatttatggatccaaccgcggaaacgactctatcgcagtctacaaaacgcttgctgatgccagcttagaattagttgaaatcgtcccaacaaatggaaaaactcctcgcgatttcacgcttagtcctgatgaaaagcatttgattgttgtccatcaagattctgacaatgcaactgtattcaaaagagatgccgaaaatggctgtttgactgagctttcacacgatttctatgttcctgaagcagtttgcgttacatttttataagtcgtttcagttgtgaaatccgtacagttttggtttaatagtctcataggaggtgatttcaacatgaatccagtagatctttttaaccaagtaaaagaattgattgcaaacaaagactttgatggtgcaaaacaatttatcgaagaaaacaaggaccaattcggtgaatacttggaacaagcaaaaggcttgttatcaggttctgaaggtgttaacggtcttttagataaagttaaaggcttgttctaatacatgtaaaaactaggctgagaatgttcagtctagttttttgtttgttcaaaaatatttgttatctcttgcaatgaaggaattatccaatcgctcttcaatttttcattttcactggcatgcttcccaaaacctgtcagtatccgtacagtccacattcccaaagatttagcaggcagaatatcattatcaaacctatccccgacatagacaactctatctgcagggatgtttgttttttgcaaggcaagtgtgaaaatagctgtatttggtttagatagcccaacctcttcagagaggatgatgagttgaaaataagactcaattccccactctttaagcagttctctaatactactagactgattggcaataatccccaatcgatagttttgtgataacttctctagagcatctattgtttcaggatacaagctcacaccctcatttgtccacaaaggacgtggctcggtcggtgcaaaatagtgccaggtcgaacgaatgggatccagcgacttatgagcatactccaccattttctttttataagaatctgatgaaacctctatatccagagactctaacttcttcacacacttgtctatataataaccataagcagcctcttcatctaaaagcgtcgaacccaaatcaaaaaatatccactctatcatcccactctccatctcttttcaaaatgagaatacttaagttgatctgcctttttagaatatcattttatcaatatcaaggcaaagaaaattccctaggaatttcagtctagttttctattcattcttaaaaatagttaggacctatcttgtcatagattttcacgcatcaatagacatctttacgatgtccaaactcaagtgctaaaataaccaacttatcatcttgaatatcgcaaatcagtcggtaatctccgatacgataacgccactcgttagcatgattgcctgtcaaacctttaccattggcgcgtggattatcagtcccttctaagtgtttatcaatccaagcaaacaacagcctctgaatttgcctatctaatttcataatttgcttttgagcctttttagaatactctaaatgatacatgctataatcctagctctttcttaaaatcagcatgactaattgtttctggatctgctttgtactcatcataagcttgatgatagatttttaaatcatactcatcttcaatatcacgctccaaagctttcttaaaaaggctagaaagactttgacctgttaattgtgcatagcttttaaagaatacttcttcttcttgatttaatctgattgtcactgtactcatgatattcacctcgcttctttgtgttacattgtaacacatttttaaagtatctgtcaatctatcaaaaaagtaccttgggatgatgccccaaagtgccttatatcaaggctttacagcccttaaatcatataaagtcaaagaacaagtccgaatattttcagacttgttcttactatatccctcactatactagctcggggataaattagtacactgtactacgaaaaacaagtctggaaatttccagacttgttcttactataaccctcgctatgctagctcagggataaaacagtctcccagactgttttattttttcaagttgtagaatgagttcaagcctttgtagactgcaacttcaccaagttgatcttcgatacgaagcaattggttgtatttagcgatacggtctgtacgtgacaatgaaccagtcttgatttggccagcgttagttgcaactgcgatgtcagcgattgttgaatcttcagtttcacctgaacggtgtgatacaacggcagtgtagccagcttctttagccatttcgatagcttcaaatgtttcagtaagagtaccgatttggttaactttgataaggattgagttagcagcaccttctttgataccacgtgcaaggtagtcagtgtttgttacgaagaagtcgtcaccaaccaattgaacgcgtttgccaagacgctcagtaagagctttccagccatcccagtcgttttcatccataccatcttcgatagtgatgattgggtatttgttaaccaattcttcaaggtagtcgatttgttctgcagatgtacgaacagcagcgccttcaccttcgaatttagtgtagtcgtaaactttacgttctttgtcgtagaattcagatgacgcacagtcgaaaccaatcatgatgccgttttcaccagcttcgtaaccagcagcttcgatagcttcgatgattgtttcaacaccgtcttcagttccttcgaacttaggagcgaaaccaccttcgtcaccaacagctgttaccaaaccacgagctttcaagattttcttcaaagcgtggaatacttcagcaccccaacgaagaccttctttgaatgaaggagcgccaactggcaagatcatgaattcttggaaagcgattggagcgtctgagtgagaaccaccgttgatgatgttcatcattggagttggcaatactttagtgttgaatccaccaaggtaagtgtaaagtggcacttcaaggtagtcagcagcagcacgcgcaacagcgatagaaacaccgaggattgcgtttgcacccaatttacctttgttaggagtaccgtcaagagcgatcatagcgcggtcgatagcttgttgatcacgaacgtcaaaaccgatgatagcgtcagcaatcacgttgttcacgttgtcaacagctttttgagtaccaagaccaaggtaacgagatttgtcaccgtcgcgaagctcaactgcttcgtgctcaccagtagaagctcctgaaggaaccataccacgtccgaaagcacctgattcagtataaacttcaacttcaagtgtagggttaccgcgtgagtcaaggacttcgcgagcgtaaacatcagtaataattgacattatattactctcctttgagtttaaaattgttacatagctatcataccctaaaagaagggatttttcaagaaaaaacaggttattttactgaaagaaataatgtaaacgccttccttttcaaagttaactgagtatgttatactgaaaccatgaacgatttaaatactaccatactacagaaagcctctggcgaaacacgattgaatccagatgaacagcgtctatacatgggaacctatcgcgaacgggttgtcctgatcgtttcctttgacgatttgagtagtgaagtcgtcggaaataagttcgatacaatttgccaaaaactagcaaacagatactctcctctattcctcaaactctcgccagccctgtctgacaagcaacaaatttcactactaaaaattgctcagacctttggcattactaccgctatcatcgatgaaaaaataggacaatctccctacgcacttgtctttcacacaaatcacgctgtggataatgaagaagttagcttagaatccatatttccaaatcttatctcaaaaccagaagaaaaaaaggaagatgcaaaaccttccttctggaaaaaattatttggttagacttatttaacgataaagcagtataaatattaaagtaaaaataatacaggttagacaaaggattcctagcaatctgcctctttcattttttcattgaaaaagaacattgctccgtttgcctttattacattcatttccgttactctttctttttcggaaagtctcataacggatactagctttgcaagacaaataaaaataaataagataatagccacatatttcactaattccatctttgttggcctcctaactgaagaattcttgccacctgctctgccgtgcggaccaggtttttttctgctttttgaagcgtgtcctccaaactttcaacgcttgcaattatcggaaaagcggcgcagatattttcaaaaggaaactcgggaagatcgtctttgaggctaccacaaattgcaatgatgggaatccccgtcggcgtccgtctagctactcctattggagtcttccctgataagctttgggcatccatccgcccttctccgaccacaaccagacccgctttggtgacgcgatgatcaaagtccaactgatccaagacaaagtcgatgccttttcgaatgcgagcaccagcaaattggactaaacctgctgccatacctcctccagcacccgctcctgccaaatcgagtagcattggattaactaatttataaaaggactccattttcttgtctactagttcaaattcagcagaggtaagacctttctgacctgcaaaaacaaatgtggcacccgctggtccgcaaagcggattctccacatccgttaccaaatcaatcctgacctgagatagatctaccaacatatcctctgtggaaaagctgacaatctccccgatatgagctccaattgcctctacttcttttccctctcgattataaaatttcactcctaaacctgccgccattccgataccaccatcatgactggcagagccacctactcctataaatatgcgtttaacaccattttgaacgagctccacaatcagctccccaaccccttgtgtcttaataaagagaggactccttctttcatgcgggatacttgccagccctacaatctcagccatttcaaaaaccgcaagatcatctttaaccgcataggaaaccttaattttatctccaaatggacctgtcacccaagtctgggttccatccaaggataaggcttgcattagactctcaactgtcccttcgccaccatctcctaggggaattaagtcataccctgcttgtgggtaaactttagaaaatccttttttaatcgcttcagcaacctttgtagctgaaagagactctttaaatgaatccggagcaatgagaatatgcatggtactaacctcctttatattattagtatatcacgctcctagtcagctttcaataaatcttttctgtttttcatcgtctgtgttatactgaaagaaaggagataagtatgtatcaaactatattatttgacttagatggaacacttactgattctggacaaggaatcttaaactccgtcgcctacgcactagaaaaaatgggaatcgaagaaccagatacagccaatttaaaccgattcatcggtccgccactctatgaatctttttctcgattctaccaactcagccctgaagatacacaaagtgcagttgatgctttccgtgtctattttaaagaaaaaggaatgtttgaaaatcaactctatcctggaatcatccctctgcttgaagaattgagaacggctggaaaaacactagtaattgctacctcaaagccagaaatatttgccaaacagattctagaacattttggtatctcacactactttgatgtcattgccggtgctagtctggatagtagtcgcatcagtaaggcggacgtcatctgctatgctataaatcaattagaagcatttccaaaccatgctgtgatgattggagatagggaacatgacattgaaggagcacgcatgcaccaacttcccgccatcggtgttctttacggctatgggaacaaacaggaatttgaaaaggctggggccaccatgatagtcgaaaccgtccaagatttgaaaagggttttactgacaacagaatagaagatgctgggcaaaaagaccaacctcgcttctcagggttcgtgtcaacatctcagcgcagtggttgattggcagatttgttcgtgttttacactccaaatctgacctctatgactgatgcgaacagagttcgcttcatttccaacctcaaactgtctcccagacagtttgagctgtgcgggggtgggagtgaaacagtctggggatagactgtttcagctcaacaactagaaataaagacttgttgacgaactctttttctaccatttgtcaagtctatcaaggctttaagcaaaaaaataaagcataacagtagctattttgaggctgctaccttatttttgtcactaatttagctataaaagggcatgacaaaatgacaccttatctagtattttttgaaataaggtgttacaatgatagagcataaacagttttaccgattttgggttgaagcgtaatcgtaaagtttgttatgcataatgaggtaatacattgtccgaatgagacgatgtatggaggcaatcgtgtgcggcttcgttgaagtcgtttgcgattgtctttttcgtttctcataaaagtctgcgatatggcaaggattggtatgactgactgaagcgatattgtggatacacttgaacagaatctttctagcgtagggattgccacgcttggtaatgtgttccttagcgaggaagttaccagattcatagtgtctcaggtcaataccgataaaggcattgatttgattggcagactgaaaacggcgaatatctcccagttcaccaataatacttgttgcagtcgtctcagctattccaggaatagagagcagaatgtcatattcaggtaatggctgagctagttccaccatttggtctaagactgcttgtctctgttcagaaagccgaagcaattcttttgcatagtaatgcacctcttccagtattggagaggttttcttgacggcacaatacgattgattagctagtgctgtcagcttctcagctaagtacgccacacgcttgtcagaaatccgttttgaggtggactgacgaatgctctttgatagttcattcttgcttaaatcaagcacgaagtccttgcaaggaaaggttatgaccaagttccagtattgttcgccagttggtgttgacaagatattttccaattcagggaaagtgacttgtaagaccttgtgcagacggtttttagcccgaacaatgtcctcggtcagattctgatagaaacggctgagatcccgcaagttttggtagacttcttcttggacataagtgggtttacgattcagcacaaattgagattgagccagtttttcagcgtcaatttgatttgttttccgcacacgcaagctatccagttgcttcttggcttctaagggattgagtcgtgtataagcgtagccatgttcatccagaaaagcttgaagacgacgagaatagacgcctgttgcttcaaagatgatttctggcttgtggacggttttcaaatcgccaagtagccgagaaaagccaatggcatcattggacatggtgtagttatgtaccttctcgccgttgactagaatggccacttctgaacttgccttactcacatcaatcccaaaaactactcgcatgatattacctctttgtcttgaatgattccttgttttagtgatgtcattttcaatactcgacgtctggcgtcccacatactttgataacattctttctaaaacaggtgtcttgccagtttttgttgcgacgtctagcgtcaaaagagttctcgacttaacaagacacctctactttatcataaagaaaaagtagtgagtactttctcccgtcggagatttcctcactactaatcttagtatgtttttgattagtcgagttctttcccgctcccattatttactatctaaaatctctattagtttatagagatttttttcatttatttggtagggcacctgttcttggacaatcggtttagcacagaaagctactccaattcctgctcgttgaatcattggtagatcatttgctccatcccccatggcaatcgtttgagatagactcagcccattttctgccgcccattcttctaaacatgcttttttagtatctttcgttacaatttcacccaacacttgtcccgtcaatactccatctactacttctaatcgattagcccgaacatagtctaactctaactgtgcagctagtcgatcaactgtttcatgaaacccgcctgaaacgactgctaccttatagcctcgcatttttaattctgagactaattctgctgctccaggcgtaaagtggatttttttgataattcgatcaaacacagaaacaggcaatccctttaacaacgccacacgttcacgtaaggcttcttcaaaatccaattccccacgcatagcacgttcggtaattgctgcaacttgcgctcctaaaccggcctcttctccaagtaaatctattccttcttccaaaattaatgttgaatcaacatccataactaataatccagttgtcatctccaatattcctttcaatgtataaaaataaaaagccaaatggctttttatctagtagcgaatggcttcgcgagttttttcgtatgaacgcacaaaacgctctgttacaccaggttcaactgtttccagagcaaatgaaatttcttcaaatgctgcttggtaatcaaaatccttttcaaaaattgataatgaacggttaaatgctttttgcacactttcatcgaatgaacgataacggttagagtattgtagcaactgctctgtcaaagtcgcattttgcacaatcaaatacgccaactcttccaattgattcatatcatacgttgcattttccaacaaacggttaacaacttcgatattgattcgtttatagtctaactcggcaatcaaggcttccacatgatcgctcgttctaaagaagtttgttaaaaattcagctggaattcctggaaggttgcgtttttccatataacgcttaagggtatgcaatttgttgatataaagtgtagctttcttacgcgctgtgttctctgacaattcttgtgatttaagatagtcagctaaaacaagctgctcctcttcgatttctttcaagcttgccaatgaatgatccaaacgctcttctaaaatagaatatgcaacttgtggattttcaatgtcttccacactttctgtaacaacaatctcaatcgattccaaacgagctttaagctgattgatacgtgaaagtttgctatctgccagcaagtaagttgcatttaggcgttggctttcctcatccaagagctgtgtattttggacaacatgctccaagaattttggcaagtttttactaatcttaacagcttccttattcgcttcgatttcacgattgaagactttatacaaatgatcaatttttgcttgaattccctcattttcagcttctgcggcatccaaatcaaaggaaacaatcaaagcagtattttcacgaattgaaacgcgaatattttggaactgtgactcgatgttagcttctgtgaacaaataattctgctcaaccagtttacgataacccgactccaaatcttccaattgctctgggaaatcttttgtaactcgttcaatcaaacttggaatgcgatccatgatttgattgagggcaatcatatgctcttcagtcttatcaaggatttcagaagcttcaatcgggtcacctgaggaattaagcatcacaaattcagaaaactcaacttcaatatttttcaattgtttctcaagttctgatagtgtctcaccgtagctatctggattttcacgaacagcttcctgtaaactatcgaacaagtttaacgcatgttttacgcgaccagagtttttctcttcttgctccttcaactccatcaaaccttgacggatagaggcaatatcttcttcaattaaatcaatttggctgtcgatactgtcgatagcgttctttgcactcacaaagcgaaaggcattgttatagccttctgcctcaaagatatgattttcaatatcggcaaatgaattgagcgacaaatcaacccatttttgattccattcacggaatgacacctgactttgaccaatcaaatgaagtgctttgacagtttcgacttcttcattaactggaaggttaaatagctcttccttacgttcttccaatgcaaccaaaaggttgtcatttcgtttacgaacaatcaggcaagctacataggcaatgattaaaataataacaatcgaaacgattaagatgattgttcctgtaggcatgtaaatctccttagctcatagtaattactagaaaatatcgcttaattataccataaatctctagtatatgcacttgtttttttagtttttagacatccaatgttgaataaacagcattttcctcgataaactctcgacgaggttcaaccttatcccccattaacatgtcaaaaatcttatcggcttctgccgcatcatcaactgaaacgcgtgccatgagacgattttcaggattcatcgtagtttcccacaactgatgatcatccatttctcccaaacctttgtaacgttgaatcgttggcttggaccgtcccgtactatgtctttctaaggcatcttgcaattcttgctcttgattaaccccaggttgaatatattcttttatctcacttccaaccttgataccgtaaataggtggttgagcgatatatacgtatcccgcttctacaacaggacgcatgtagcggtaaaataatgtcagaaggagtgtccgaatatgggcaccatcgacatcggcatctgtcataatgactaatttttgataacgtgccttgctaacgtcgaaatcagcaccaaagccagttcccatagctgtaaatagactacggatttcttcgttggccaaaatcttgtccatgctggctttttctacgttcaaaatcttaccacgaatcggtaaaatagcctgaaattcgcggtcgcgaccggatttagctgaaccaccggctgagtccccctcaacgatgaaaagctctgtcttcgctgcatcatttgaggaacaatccgctaacttacctgggaggtttgaaatctcaagacccgatttcttacgagttacctcacgcgcacgcttagcagcaatacgagccttgcttgccaaaatacctttttcaacaatccgtctagcaatctgtggattttccaaaagaaattctgcaaaggcatcagagaaaaggcggttggtaattttgaccacttcactattcccaagttttgtcttagtttgtccctcaaattgaggacctgggtgcttaacagaaatgaccgctgtcaaaccttcacgcacatcttcaccagtcaaattatcctcattttctttgagaattttatttttcttggcgtagtcgttgataacacgtgtcagagctgtacggaatccttgctcatgggtaccaccttcatgtgtgtgaatattgttggcaaaactaactacgttttcatgataactcgtcgtatattgcatggcaacctcaacggtaatatcatccatttcaccttctgtatagataggggtctcaaaaatgacatccttgttctcattaagatactcaacgtaggaagcaataccaccttcatagtgatattcctttgtttgctctactccctcacgtttgtccgtaatagagagatttaaaccacgatttaggaaggccaattcttggatccgcttatttaattttgcaaagtcgaactcagtcgtctcagtaaaaatttctggatcaggtgtaaaatgtacagttgtaccagaacggtctgtttctccaacaacctccaaatctgcaacgacttcacctcgtttatactcttggaaatatacctgaccatttttgtagacatggacgtctagctgagtagatagggcgtttacgactgatgaacctacgccgtgcaatccacctgagaccttataaccgcctccgccaaatttaccacctgcatggagcactgtaaagacagtttctaccgctggacgaccagttttttcctgaatatctaccggaatcccacgtccattatcaataaccgtgatggagttatctggctcaatataaacttcaattttatccgcaaaaccagccagcgcctcatcgattgagttgtcgacaatttcccaaaccaagtgatggagaccttctttagatgttgagccgatatacatccctggacgcattcgaacagcttcaagaccttccaagacttgaatctgactggcatcatattcttgagccttctcttgtaaatctttgatttcttctgtcatttcttttccttattttctatttgttgctccttaaaaatagaaaagccaatccatctggataaaagcgaaacatatttttagagcaaaaatcattctaacgaataccctttattataccatattttctaatattttgatagaaaaaagaagaggaaacattagctccatcttcttcattactttaactatgataaaccattgtttgagctaggctttccccatctccaccaaataaatcaaccaatttataggcgaaatccaaacttgttccagcacctcggctagtgataattggaccatcaacgaccacatcctcttccagatgaatacctgacggaatgtctttttctttccctgggaaacatgtatagtgacgactatctaacaaaccagccttatccagaacaattggtgccgcacaaattgctgctactgattttcctgatgcaaccgctctttgcaattccgtaatcagtgactctgaatctctaaggtgaacagaacctggcattcctcctggtaaaacaatcagatcaaaggaagacaggtccccatcaaagacttggtcagtttgaacacgaataccgtgcgatccctccacttcatgactatctaaaccaacaatctgacagtcaaaatgagctcgacggaatacatctacagaggccaatgcttcgatttcttcaaaaccatcggctaaaacaaccgcaactcttgtcatataaaccaactttctaacgttttatcgtaatttttctatagcgacgtgatcgatttgtttccttctcatcagctagtcgtgactgataccccattgacagcactagaccaacaccaatcagatttgaaaccatggacgagccaccttgggagataaacggcaaaggaatacctgttaaaggtaacaaaccagttgcagcgccaacattttcaaacacatggaacaagagcatcatgatatagccagttgatatgtaggtgtagtatcgattgtttgacttcaacgttacccgcagcattcgataaatgagcaacaagtatagtccaatcaataccgtcccaccaataaaaccaaagtcctctccaatcaccgtaaaaatcatatcactttctcgaacaggtataagaagatttgttttattgaaacctagtccttttaagccaccacttccgatagctatcaaactttgagcttgctggtaggtcgttgattgggcatttttaaagggatcaagccaggctgcaatacgattgattttataagtatccatccccaaattgtggagaaatgttgttccaccaggagaaataaaaatcagcataaatccgccaaccaaaacgatacctgttaaggcagtcggtaatagaattttccaagaaactcctgataatagaagcattccgctaaagattgctacaaatactaaggaagttcctaaatctttctgtaaggccaacaaaatcaggacagggatagtaaacagtgtcatataaccaatcaacataaaatcctcacgaatttttcgatttggataatatttatgaaaggtgacaatcacccttgacaacataatgatgtaggctattttcataaattcggatggttgaaaaagagtcattccaccaatcgttacccagttttttgctcccgttgatgctactaagtctggactgtagaaaaacaaaggcaataccataagtcctagcccaagtacgtacaagtaaggtgtgatttgccacagaaacttagtggaaaagaacatgaccaaaaaagctgccactgttccaattcctatccaagcaatttgttgaccaaccatctgtacaacattatccggataatcttgactaaccgcaatgtagagagaaataatccccacaactaataaaaaaaagaccggtaaaataagtgagtagtctactcgactatcgattgttcccctatttttcatcaatttcctcatactttcacttcaaattcttactcgttccattatagcagaaatcatctctcattgaaactaaaaatctagttacatcagtggggatacgatttatactcaacgaaaatcaaaagtagcctaggaaacgaagtcgaagatagaactggagttcatccaggcaagttgacaacggataattttgattttcgaagagtattactagtgcacaaatcataaaatacgtatatcttcataccttcgaacaggctgaaatataatgctttaccttcacacaccccataagtttgctcaattcatgagtatgtagaccaatggcaatcattttggcaatcacgcacgaaaaagccctctcttatttctagagtcaaagaaaaaatggtccactggaccataactcgctcttttattttcaagctcgtgaaaaaacagtccgttaaggactgtttttttatttgagaccgtattttatacccttttatttattatcatttttcattaaataataagataactatataaatagaagaaagattttattaaattcttatatattcttatcaattatcatcaatcggaactttttccgttactaaaacaaagattttccccacctattccaaggaataaagattaagttattttatacacttttatgaaataatatacaaaaagttggtattgccagctttttttaatgtctatttcaaattttacactattggtatttttattattttttatgtatcaattttggtcaattttgggggagagatacacaagaggattgacaccgttattttctgcatgtgctaacattctaaaccaggggggataaagaaaaagtctcttgtcataaattctacaaaatttttaccccctttttgtctaacggttcccgacttggaagaagttcccttactcggttcccaatcatttgaacatatttcaacagggtaggggggtaaaatataaaatcaacaaactattataatctaattcgtttttgacttacgataaatgtatgctagatatattttccgatgtccctttcccgttgcacgtttccccagcagaaaagcggtttgtttaggcatgggggcttatttatactagactactatcatcagtgtaatagttgtttataatatttttcacgcgagaaaaaatgtacaatgacggcgtgaagtccaaaggcgatagggtggtagggtacacccccctatcttccaaatgcactacagacaatagataagcccttaatactaacatgtaaagggcttaatggttttatattcttttttgtatttttggagtggttttcgtgttcgttgaattagtcatatcttatattctgtctaattatgtttcactctctaaactcaatactatcaaggcttttagctattccttaaataattactagcattttcttcattatgtctaattaacactcgatatttcctttaaatgtcaaaattagccatcttagtatctaggtcatcttgtctaactcctatgtatattagcgtgattgctgggcttgaatgattaaatatagacatcaaatcagctacattcttatactttttataataatgatagccaaatgttttccgcatggtatgagtaccaatattttctatacctaaatcattcccagcggtctttaatatccagtaaactgtacggcggtcaagcggtttgtttacaccgttacggctttgaaaaagataatgatggagcggtttgccttctacatacttccttaactcattctttagggttcgggtcattttaatagttttctgtttaccagttttttgttcccgtactctgatgtgccagccttggacgtccttaactcttaattttaaaatatcgccaattctaaaccctgtgtttattcccacaagaaatagtatatagttcctttcattccatgaccttagatagtccttcatggcttgaatatcgtccttgtcgcgtattggctcaactgcattcattcgcttcttccctttcttcctcacgcgcattcagattgtcatattcactagcggacttattcgggaaatagtgacgctctaagttttctaaccattgggcgtgcccttccatcattcccttatactttccatcggttcgcgttctgaagttctctacattggtttgcttcaataattccaccttctttctgtattaaaattacaacaccttacaacgcttaacaacacttagaattataaagtgttgtagcggaaacccttggggcgcaaggggtttggagatgttactacacttactacactttttttgaatacgttgaattttttataatatatatacatacacaagaaagtatatttcttttttattactttatatattataagtgtagtaagtgtagtaatattccgtaaagcgttggggctgttggggtttcgtcactacactttttctaaaaagtgttgtaacttattttttcttatagcccctctgcgccttccctttaattggcacatataggggtaaatagtggggctggtcatccttggggtagaaacctttgggaaggtctgcccctcttggtaaactaataggataagccaatttttcccagttatcgggtaaatattgcggaaagtgagtatgaaaaccttgactactgaaattatgttgaaaattatgataatctgcaaaacctgtaaagtaccaccatacccaatcattaggaataaaggtagaatgtaaattagtaaatagattttgtgaaaatgctaaaacagggtctatagtttcctggtattcgtctagtaaatctattgacttgctaggctctataaagtccttgaaatctaggtcgataactgtttttaacacgtattctaggacgctagggcgcgtgatataatcgtttttaattgctcggttaggtttccccttaaagtgcttattaaagggtaaaataaccattctacgccgtatagcgtgatagtctccccgtatctttggtagggtgtttgttgattgaatgacaacggtttttataaaagtactatacgcgtcttttccttttttctctaccgttacagtatccccaccaactaggctgaatagtttagaagtatcacgaataaccgcaccagcttgcacatcgtcgcctattatggcttgttttccgattgcttgggctaaggtaaaacgattattaacatctaagtctgttatctttatacttgctatgttctgccgtcctattaggtttataaataactcttgtagcgttccctttcctgttccaccttctcctacaaaccaaaacattttagcgtaactttctccacgtacaacggcattgagtagctgaagtgataactgataaagttctttatccccgttaaataaatctaatagccagccattaaactcccagccctttatagtcgggctttgggcgtgtggattgtagttggtttgtatcttatgagtgaatacccttgtatctgtaaatggttctagtgtccgtgtctttcggttgtagataccattgccaactattatcaaatgtggggcgttttccgcctgtctatgtggtgcttttcgggttaagtggtaaatacaatcgctagcccttttttcgttgtgccgtggctctataatacttataaagtcttttaaaaattccctatcattgatataaattccctcatcagggttataaaaataaacgggttttgttccctcatcgctttcaattctgcaaactgtcagcaattccgccatatattgggcaactatcaaaggtggaacaggctttttaatttctgcttgtgcctgcttatcgtctaacccgtcttctaatagctttctatagcgttcttcctgcttgtgttggacaaattgaaatactttcccttgccaacctttaaacgttctaagccgtatatcacgcgcattatattgcgtttctcctgttatttgtcttccatactgtgtaatactgcccaccttctttctatggtctagcttatgatttttgtatcttgtttttgctgattgataatgtatgctattgtatttcctgtagcttcagcaaaataaaaccgtttcatcacatctaagaaataacttgctaggcttgaccgtttcacaatagcagtaaataagcttactacttgttcaaaatcatagccatgtaaatacatttgtctaataaaaatagccgtttcttcctgggtgtaaattccatttgcgatagtatcaaacacccagccatctaaatataacccgctggcttgtctttgctggtctaacatgtatttctcaatgtcttctagctttgctaatagacttgttttcatgatacttattggataatctctaataagttcccaccctttcggggctggtactttttcaaatactttcaaagtaatattgtttaggctgaaaggtgtgatatatccaccaaatggcaagtagtagaaaaagcggaaaaaattatcttgcattactgcgcgtgtcggattatcttttagtaaatctagtagtatttgttccccacgttttatagtcacttccacaatgctatacatctatttccctttctatgttctttcgtttctctatttgttgtttaacccattcagccctatctttatcatctgacaaagatataaaaatatctatttcctcgcgtgatatttctcccttaagaaaagctattatcacttgataaatttcggggttttcttttctaacggtttctaatatttcttctatatccattcttgaaactcctagttatatctcttgccagcaagccaaatataagccccgtagttatcgtttatatgttgcgtggtatgtttaccctcagaaacttttttaggcttgctaggggcttgaatactgcctaaaccaacgccaaaccatagaaagaggtttagcggtgtaaatattgctatgagtgtgaatgcttgttctattgtcatttcttgcatgttacttacccccttaacttctatacctcggcttctagcaatacttcaagccgtttcttttcttcttcgatttgtttttcaagcgctcctatacctgccattagttcgctatgattggctggtataaaatagcctttatgattgcctttgcggttgccaataattggtattttatgcttgattatcagccgtctaacacattccctaaccgttcttttatctaggttggtttgttgtgctatgtggcgcgccgtgatggctttttcaatccctacaccgattaggctatatatatgcttgtcgtttccttttaagtccattttgacccctttccacattgtattcttgtatttctggtattagctcgcgcggtggcgcgtgctttttccgtgtgttgacctgtctacaatttttctttactatacgtttttttatctagactatccccagcggttgcccgccccaaacttatcttgtaagtgtgtgccaaaataatagcctagctaatgtgtgctttatgattttaaaaatcttaatatcttgaaataaataatattgacttgccttctcattgtccttatggtatgattaaggcaataacaaaggtgtgcaagggttcgcccttccctggttattgtttaatcatttgaaggcttgtcagtttggtcgctggtgtaagccttttttgttgtcattctttcaacttttctagtatttcttctacatctcgcacatcatagtagatagacttcccttgacggcgtgaccttaacccacatgactttaaatatttcatgtatttgtggtcaaagccgtataactccattacttccccttgtcgtaggggctttttgtttagccgttctatttcgtcctttgccatttcacgcgccaaaactaaggcaccgcggacaagttcaaggcttgcgctttcgcttaacaatgcttctgccatttattttttccttcctgttcaatatgccgcctaaaatcgtctatacggcgtttttttattttctggtatctttatactacccgttctaaaaaatcgctagaatgtactttttttgagaatttaaccccctctaggcgtaaacctcataaaattctttgtaaatgtcgtcggggatttccgttagggcttgttgttggagttggatagcctttaggcggtttgtatcgcttgccgttggcttattgataatgtccgccgttgctaaaacttgcttgaaatactcgtctagctttaacttccgcccctcggtaatttcttgtttttcttctcgtttggtttttaagaattgaaattcgtcaatttcatcattcagcaagctataagagataatgccacggtgtcgccattggttaaaacgtgccttaattccctctatcgtccaacctttcagccgttcttggagtaaatcaaagctaactagcccattatcttcataaacctgtaggagtagttcctgtgtaaatggtgttttagtcatttcaaccccctctaaaatccttcccacgtcattagaactatatcttctgtggtgtactgtgtattttttaacgtttcaagttcttccataaccgctttaaagtcttctttgctggttttgggttctaggatttctattgctcgctcgctttcttcattgattttagcccaagcaagtgttaaataggctacattattaggttcaagcgttttttctagttcctttgtaaagttttgtaggctttttgaaatatgtttcatatagaaagcgtaggtggtaaggtggataagttccgcactattaatggttacaatgttatttgtctccatgttgtttacctcgttttttcttgccttttgctcgataatgtagggtgtgttcttctagcatttcttgaatttgtacccatgcttgggcgttttgttccaccatatcgtgtaaaacttcagcattttcatctagccccatagcttccgccatgtttacctggtcatctacccattttttaaactctttataggtttgttttttgctcattttgtattttctccttctaatgttgtaagtaaactatcgattaaggtttcaaatgttccagcaatttcatttaattctttacctagactttttccttctgattctaaggtttcgccaatactataaagtttttctccgtcctcattttttactagttctaaaaatgtgccaactgtttgtttatgctcgttatcctctccataagtgaaaagtactgtatttttgtcaatcatagtcattgtgtcttctcctttaatttctcttgtaaatagccttgtatctcccatatgaaacggctaacggcttcaaatttgcccgctagggtcgtttctatggcttcattattcaaactagctagataatcggtaatatagtctagctcttcatctgacttgttagcacgctctaggagtgcttcaagttgtttacttgccattgtctgcccctgtgtcttttgtatgctcccaaagggctttataatcgccgtcatggtctaggctttctagtaggtaaagtgcttcgtcgccaaaatctgctatatggtctagtgttgtatttactgccatttctgggaagtctgtgtctagtgtactgtccgctatatccattagcattagttctaggcggataaccctttctaagagttctaggcgtgttgcccgttgtcctaaaaaggctctacgctcaatacagtagcgttcttcaagtgtggtcatgttgtatttcctttctagcacgcgcctgcgtgtttattctttggattaggtggggaaacctgtattattgtttaatcatttgtttttgtcgttggtcgtagttttaaggggtacgcccttaaaatggtttttagttctttttctgcgcgtgattgcccttggtcggtggccaatcatgagtaaatagccattgtaagatagctagaatgtgcctagctgtcttttttagggttagataaagtagtccgcctatggtttacctcctttctttgtctgtgtcgttttcctgtagtgtgtgtgaaaggtagttaggaaaattacacatcttctagtagccaatttatgacactttcatagatacggcgcggggcgtcatagttgccctgctctactttggtcaaggtttggggcttaatacctagcttttcagcagttgccttcttcgttagcattaagtccgcacgcttgcgccgtacttttctagcatggtcttccgttagtagcatttatacacctccttccacggtcttaaaagccgttttttgctacacttgagattttaacgcatttaaaaggcgttgtcaagaaaaatacggctttattattcatattttttgtttttatgttataatgtgccatgaaaggtagttaaaatatatgaataagctaaaaactttgagaaaagaaaataatttaacacaagaagagttagccaaaaaaattggggttaacttacgaactcttcaaaaatgggaaaatggagaaagctctatcagaacaaagaatgctgaaaaactagctaaacatttcggcgtaagtgtagggtatttgttggggtatgaggacaaagtaaaaaaagaattctataaacaacttgacttatacaatttagatgaatttagaaagtttagaataaaattaaatattgaattatctctgctaaacggtattttagataatgattatgaaaaaatatctgacaaagtttcttatctaaacaattttgctgataaagaattaaaaagaggtatggaaaatgaatgtttagaacctcaagaattacaagaattatttgagttacgaaatgttgcgagctattttacatctttggtagaaacattagaacaactccaatataatttaaaaaaactgttagaggatacgggaaaagacacataaaaaacgcaaaccccagcaggtcggcgcgtggaataaatcaaaaagaaaggaaaccatgcaacattacagtttagacgaatcaggaagcattactacaaacaatgcccctaataaccgtttttttatcattgctggagtgactgccacaaacaaagataaggtaaaacgggtattcagaaaagccaaagtaaattacctaaaacacaatcccgatgtactactagacatcaaatcagaaataaaaggctctcaaatgtcaatagagtttaaagactacgtttttagtcaacttatttcaaaaacagatatacaattcaattacctggtatttgacaattacaacgccttgccacggctaagagaaaaaccaaacattacttttaattatctgatgttcttaaaagctgataaactcctaaacaatcaaacaccactaaaactagacttggacgatagaaacaagagtgtcgaaagtttaaaagccctcgaagagtatctacaaacaaagttgtgtgtagaaagtgatagggtttcagatgtgaaagttgagttctttaactcagcaaaccatactatgatacaaatagcggatattttcgccaatcatttgtatagaatattcaagcaagtagcaaaaaatcaagattataccgaaaatatggagctacttgccaaactgaaacaaactaacctacaacattgccaatacttcccagctggaaagtgtgaatgtgcagaccttttttagtgataagtagaaaaaagcacgaaaaaacgcaaaaaatgacataaatagttgaatttttcaataaaaagagttatattaattatagaaaaggctacttgtaattctgtttgtgtctgcgtattgtcgtaagctgcctgtgtggtatgccagccaacagttaagggcttttttaattttgtcattacaaaaaggtggaatagtttttattctgccttttattgttattctacgatgttacggaaaaacgccaaccccagcaggtcggcgcgtggaaatatacaaattgattgacatataacctataatgggggtataatcatagtgtaaagaattgttgtgaggacaattctagcactaaatcaaaaaagcccccaacgtgccagcgttgagggtttttgtttgcccctgtttggggttagtcgtcgttatcgtctaaataatacttaactacttcagtcaagatattaaccaataacggcgctagaatacttgtgaggataagttctagcaactaaatcacctcccttcagtaaattcagggggcttgtatatcttatcagataatttattttgttgtcaaattctccccgcttacacatggcaacgtgtaagcaaccacttataaacacgcgcatactattttattctttcgattaggtggggaaaccaataggaaggataaacaaatgattaaccaataccaactaaaagacggctctattagatactcttatattgcttatgtaggtatagatccactaacaggcaaagaaaaacgcgtaagaaaaagaggttttaaaactaagaaagaagctaaaatagctgaaagccaattacttctaaaagtggagcaagatggattttttgacaagccagatagaataacctttgaggaagtctataagatatggctggaacactataaaaacaccgtgaaggctagtacatacgccagacaaaaggcgcaagcagacctacatatagtcccagtattcggcgcgtgctacgtggataaaataagcctaccaatgtgccaaaaacaggcacaagaatggtttaagggctacaagaaatatgctaactttatcggtatgactaagatggttttagattttgcggtaaatctgggttatattcatgataaccccatgaagaagataataaagccccgtaaatcctctgaagtcgatgaagaagaaaagaaaaaagaaaacttttacagccgtgaagacttgcaaaagttcctagactgcgtagcaaaggaagacaaggaagaaatagcttgtattttccgcttactcgcctttacaggtatgagaaaaagcgaagttcttgccctacggtggaaagacttagacctctttacctcacgtttatcagttagccaaatagtagcctacggagaaaataacagtatcgtctatcaaacacccaaaacaaaaaagagtaagcgcactatcacgcttgaccctattaccgtgtctattctgaaaaaatgggaaaagactagacaatttttaaacttcccccagcgcgtgaaaccaactgacctagtttttccagcagaaacaggcaacgcccatagttttgattatataaactataatctgcgttgtattctgaaaaaatatgacttgccttatataacgccccacggtttccgccatactcattgcagtttattatttgaagccggggcatcgattaaggaagtacaagaaagactagggcatgaagatattaaaacaactatgaatatttacgctcacgttacggaaaatacaaaagaaaaaacggctgaaaagtttgcccaatttttgggaatgtaacgcccagccgttaccatttccgttaccatttcaaaaagaaaaccattcccacggcacgggaatggcttaaaatcaacgtttctaacggttttataacgctgattatttgagaccgtattttttgttgaagcgatccacacgtccatctgcttgagtgaacttttgacgtccagtatagaatgggtgtgagtctgatgaaatttccacacggatcaatgggtaagtttcaccttcgaattcaactgtttcgttagatttcttagttgaaccgctaaggaacttgtagccagtagttgtgtccatgaagacaacagtgcgatattctggatggatatcttttttcattttaaaattcctttctgccatggactctttccgagccatagattataaccatttaagtttaccaaaactttgttcttatggcaagtctttttacctatttttttaatattttttcaagttatagtacagaagcacctgaagcaaggtcagaagttactctggcgccaaatccccctcttgaaggactgcccaagctatcagaaattctttcttcaccagcaagaactttctcagaaagccctgaggtcactagaatcctgccatccagcccaatcagaaccgcttcgataccatcagtttcttctaccatcttataaatccgagttatttcttgaccaaacagtcgagtcgtccaaatctcaccatcaacagattgtttggacacaatggtcaaactagccagctgcgactccattggatagccggtctcaggactcaaaatatgatgataggtctttccattcacggtaagggttctttcgtaaataccagaggtgacaaccgattcttctcctattttgaggacgagggcattttcaccacgtggtttctgaggatcctgtataccaattcgccaataaccatctgcattgtgaggagcttgaccaaaggtcaggacgttgccacccagattaatcagcccagctgccacacctattcttttcaagaagtcaacaatcttatctgctacatatcctttagcaagagcacccagatcaatcgccataccttcttttttcaaatagactgtctgctcctcatcatctaattcgatgtcccttggattgatgagctggagtttttcactgatcatttcttgggttggaagtttggcatcgctaaatccaatccgccaactttgcacaaggggaccgatggtaatattcaaaaaagatccctcagccagactgtgttctttgcccaattttatcaattcatacaggtcatcggcaactggaactgcttgaacaccagcgtttagattgacctccatcaattctgaagtcaaatcattggcagaaaaccggtctttataaagataaagtagctcttcgacctgatctaaaattggttctgcatctggatgccatattttcgtttcaatgatggttcccattagacgaagggaacggctacttgcttgcattcctcactacctcttggatttcttggtatatttgctcattttcggatagtgaataagagttagcaccacttgctagtgggtggccaccgccatcatggcgtttggcaatctcgttgattggaagatacttactgcgcaaacggactctgtaatttccgtcagtttgtttcacaaaaatcccccaagattgaacgattccaatccgtcctggagccccaacgataaaggaagtgtccgcatcggtcaccccgtatttttcgagaatgtcctgtgtcaaaataacacgcgccgcaccatgttcatccacttccaagttgtcgtagacgtaacctgtcaacttggcaatcttgaaatcaatggtatccatctggcgagacatccttgcaaagtcaaaatcttcttggcggagacgagcaacaatctcaaaggtgcgcgagctggttgccggatagagaaagcggcctgtatcgcccacaattcctgcatagagtagacgagcaatctctccatcgagttccagttggcattggatggctagttctgtaatcatttcactgcaagaactagcttccgtattgacccagagcaggtcaccataaggctcttcattggggtgatgatcgattttaatcaagaaatctccttgagcatagcggtcgtcatccacacgcgccgtattggcagtgtctgtcacgataaccaaagctccttgataatcttggtctgcaacttcatccattcctgccatccaagcaagatttggttcctcaaaaccggttaccttgatggtttttccaggaaaactcttctgtaagagtttctgcaagccaacttgactaccaatggcatccggatctggtcgtttatgtcggtgaataataatcgtgtcgtattcgtgaattttttcaataattttactgtaaattgtcatagcaactccttttcatcattttagcataaacttccccttttgaaaatgatgggagtgtggtataatggaattactatgtaatttggaggaaattatggcactagcaaaaatagtttacgctagtatgactggtaacacagaagaaattgctgacatcgtcgccagtaagctagaagagttaggtttggaagtacaggttcacgaatgtacgactattgaaaccgaagaaatcttggatgcggacctcatcgtggtagccagctacacctattcttacggtggagacggtgagcttccagatgaaattgttgatttctatgctgacctagctgacttagatttgaccggtaaggtctacggtgtttgtggttctggcgataccttctatgatgacttctgtagtgcagtagacgacttcgatgtcatgttgggttcacgtggtgcaactaagggtgccgaaaatgttaaggtagatcttgccgctgaagatgaggatattgttaaccttgagcaattcgcgacagaccttgttgctaaactagatacaatgaattaactgacaaacagactggcttatcaataggtctagtctgttttcttttagccttttattaagattgtacacctattgcttgcaatcttaatagttttgatatataattaactggttaatttttttgaaaaaaggagaattttatggctaaaaaatcaaaaatggcacgctatcagagacaattggagttaatcgagcgctatgcggatttacgtaaaagtctcaaagaaaaaggtgactatcaagcacttcgaaaattgcctcgcgactcaaatccaaatcgactgaaataccgcgacaagaccgatggccgtccgcatgcttatatgcgaaaattcggtgtgagtcggattaccttccgtgaattagcccatcttggtcaacttcctggggtaaaaaaagcaagttggtaacttcctcaaacaaggctagtattctgccttgttttttgctatactaaaaaacaactgaaacaatatacggaggtttataagatgaatttggattgcatccgcgaacagattaacacgattgatagccaattggttgaactacttgaaaaacgaatggagttggtcgaccaagttacagcctataaacgagcaacaggtaagcctgttttggataccagccgagaaaatgctgtccttgaaagagtcggaaaattagttcaaaaggatgattaccgctctgccattcaagcaacctttagcgatattatggcccaatcaagaacctatcaatcttccaaattagcgaatcatgagcaataagatgaaacatgccatccaactccttttcttttccagcttaattggagtcggtgcaggaataatcaccacactttttgggaaaattctactagggattggagacttacggtctgaatattttacatatctaatcccctttctgccacttgcaggtgtgttgattgttttcatttatcaaaaatgggggagggaagtccaagcaggtatgggcttagtcttcaaagctggacaaggggagaaagcgcaaatttctccagttctcattccactcatcatctctacaacttggctcagtcaccttgtcggtgcttccgttggtcgcgaaggtgtagctgtccaacttggagccagtctctcacactggttacaaaaacatggtttcacacacttgcccaaagatatgataacaaagattggtatggccgcaggttttgcagggttatttcaaacaccatgggctgctggtttctttgccattgaagttttaatcgttggccaatattcttggactagtctcccctattgtctagttgccgctttcacggcttctactacttcccatttactgggattggagaaattttcgcataccatcgctactacctcattctattttacagatagttttaaatggctatttattgccctttgcttcggtttcatcggcaatttatttgctttgtttctggcgcaagcaaaaagcatctcaactcgatggcttccaaatccttacattaaaatagctatcatgggagttggactgaccgttctactatttttcttccatcaaggtcgttatactggtctaggaaccaatttgatcgatgccagtttagctggggaacaggtgtttgctttcgattggctactaaaactcctactaacctgtctttgtttggctgcaggttttcaagggggcgaagttactccgctctttgcgattggggcaagttctggggctgttttagcaggattactaggtctaccaactgaacttgttgcagcccttgggtattgtgccgtatttggaacagccaccaataccttactggctcctctcttcattagttatgaagtcttcggcgctaatatcctgccctatgctattcctgtacttgccatagcttatcttataaacagaaaacagactatttatggacagcagttgaggaaattcaataatgcaaaaaagcctatcatctaggctttttcgtatactcttcatctcccctgcaggaatcgaacctgcaactaattcttaggaggaatttgttatatccatttaactaagggaagtctgcttctctattgtaccccagaagagagcagattgcaagagcaaggttatataagttttttcaaatctttacaaaaagcagaacctactctaagatgaaacacaattgtttttatgtatttctctcataatagtctctaaaagaagtaattctaaaatgtacttcgaaagtttgtcgtttttatgcttgattcctactccccttccttacgtctcactgagacagccattccgagtgaaactaagccacccaagctaataagaagtgagcctagggcttcttgaccggtatttggaagtgtttgatttcctgatgctttttcagttttcttatttgaaataggagccatacttccagatggtgccggttgctcggttgctttctgatttgttacactatcgccaccgtcatttgctttctcaggtgttttcacatcagtagttgtcccagcattatcttctttttcttctgcttttggttcttctacgtacttctctacaaatgcttttctacctggaattgttgcactaatggtttgacctgctttttctaaatcagtcaagtactccacaaatacttctgtatctggattgatagcaccaatcagtttagcttctttgaaaatcgagaagccatccccaccaccaaataagaagtcgttgatgacaagtgtataggtttctgtcggaacaatctccgtcccatcttctttgaaggctttaacaaccttataaggattttcttccgttggattgtcagccttcgtgtagatatatttaattccagacatttgaaggaaatatttttcaccttcatcatattgttgatttaaggctgtataaatctgctcacctgtcatttgaacgacttgtaggatattcccaaatggttgaacagcttgtgctgctccccaagtaactgttccatcttcttggaccttcaaatctgcccgaatcccgccatcgtttgtcattgcaaagtcaacatcataacccgatttcttagcgatagctaattgagccgatgttactagattacctacagcactttctttaaattcattcacttcgcgtgaaatatctgtcgcttgactagctgtagcaattttttgctcagttacttttttaacaatggtatttgcctcatctacaattgcctgaatttccggacttggtgttttctgccctggtgctactgcaataattttcgcagtcggaacagctttaaagtcggcaatatctgtatcataaacagccctaacatctgcgtaagccttaccttgtgaggtagcttgaacaatcaaggttttgcccgttgtaccgtttgtatagacatggttatggccagcaaatacaaggtcaactgagtgttcaggatagatttcatttagcttagcaatcatatctgcagcttcaccagcagccacaccatccttgcttgtagccggaacgtgagccagtacaactatcgcatttacacctttttcagctaattcacgcgcatatttagcaatcgtctctgcctcattcaaaaaagtgtactgctcatagtttttcttcaaaacaagattaggaatttctgtcgtaactacaccaataaagccaatcttagcttctttatcattcacgggaatagtcttaatagcgtagggcttccaaccatacggaatttcacctgtttctttgtcaataacgttagcaataacaatctcctgtttagcagcttcacgagtataattatctacaatctcattaaactgacctttttttggagcttcaccagtcatgatacggttatactcatcaagtccctcatcaaactcatggttccccaaagttccgtattcaacatccattttattaaagacttttacagttggttcatcttgcaaaagtccagaattcgatggacttgcaccaaccatatccccagcttgaacacggatagactctgcaggtgtctctgtttctgctgctgtttcttcaaattctgcttgtgaatcatccatgtaagcatcaagtaaagcggcagttcctgcattacgaactgtttccccttccaatcgcgctgtccccgtcatatcaagcgcaccatggaaatcattaactcccataatttggacagctaattcatctgctaaaacagcttgtgttgcaataacgctaaaaccagctacaagagctagtatactgcttttcaaccgaatattctttttcataagcaaaacaatgctccttctatttttttcatattgacatatctataataatccttttcttacggcttttcaatatcaaatcagtcatttataacaaaaaattataaaaatattcgtttattcttacttttacatcatttttctgaaaatatcttgtcatttttatctataatacgaaaattccccttcttcccttacacaattctctccaaaatactcctcacaactaaaaaatctcttccaaacggaagagaactgttcttatttagctgctttataaagttcgttaaccttgtcccagttgattacttcaaagaaggctttgatgtagtttggacggacattgcggtagttaaggtagtaagcatgttcccaaacgtccaatgccaagattggtttcaaaccttgcatgattggtgtgtcttggttagcagttgagataacttccaacttgccttctttattaacaaccaagaaagcccaacctgaaccgaaacgagttgttgctgctgcagtgaaggcttctttgaaagcatcaaatgaaccaaaggttgcatcaatatctgctgccaattctgctgaaatttctgttttttcaggtgaaagcaattcccagaaaagagcatggttcaaatgaccaccaccgttgttgatcaaagcttggcggatgtctgaaggaatttgctccacatctgacaaaagagctaccaagtcttcgccaatttcaggatgtttttcaagtgctgcattagcatttgcaacataagtcgcatggtgcttatcgtggtgaagggtcattgtttctgcatcaatatgtggttccaaggcatcgtatgcgtatggaaggtctggtaaaataattgtcattttcgttttctcctatactaagtgatagttctattctactccaatgtgagagccttttcaatttatttgtctgaaaccacggttgaccctcaatctaagaatactctttttactatgtagtcgcgatttttaataatagcaaatcaaataaataatccttatcaaattggccggttttaatttgaaaatctgtatcgattaggagcttgacgacttttttcaaaaatccaatggacagatggcgtgaatcacgcaaagcatactttacttggtatggattcaccttacgccccataatagttgataactcagctactatctgctgttcccctcggccttgctctagtagtatttgcacttgtagataggttcgaaattgggttaacatgatggcaatcaacttaacctcttcctccccttgcaaccgcaagtcacaaactaagttgcgagcatcgtctaccttggattgtagaattaactgtgttaaatcaaagatattatcttgtagtgtttttgggatagccgcatcaatatctgaaatttcaatcgtctcttttcccttataagattgaagaaaggctaggttcttactgatttctgcaaaatcaaaattggacttttctaaaagatattgaaaaacctctcctcccatctgcaatccaagacgcattatctccttttggaaatgatttttcaaatccatctccttcagaggattggcttctaatactagtccatctcgtttgaggagtttgaccagacggcgcttactgtccaacttacccggtgctagaatgaccaaacgtgttgtttcgacaggattttccaaataggcctcaaactgtttgagttcatcatctgtcaaatgccgttttttatctgtcgttaaatctgcaaaataatcaagaatcactactttttcatctgaaaagaagggaagagaaactaggtccaagtctacctgatgataatcagcctccgacatatcaaaataggcaaaacctaaatctgccgcatcaaaatgaagcttccgcagaagtaagtctttcgctatttggtattgtccgatgtcttcaccgcataaaacggtcagaagctctaatttctctttttttaatttttcaatctgttcaattactgtcataaaaacctcaaaattcttttctcattgtaccacaaaaagagcctagacataaagtctggactctttcattgaaatttatatcaggaaggtaggaaaaaattaattgataatcactccaaatgacctatttcccaaatagcagttcctttgttagctattccaccatcctttgaaattccaccaagtatcttgaaaagtatcctttatccgatctctccaagtcttattttcttcttcctcaatagaacgtttgaacaaggcatctgcgtactcatcctcttgttccttttgattctgttcaactcgtttcttttcgcttttatatactaattgaccaaaatacaaattcccatcgtctgcaaattttaatgtaacaacatcaccttcttcgagtttcttattcaattttacaacataatctccactgccgtccgcacgttccccacttgtataccactctctagtttggcaattctctgtagtataactcggacacttgagttcatgctttacaggctcgaccttcaatcgttctccatttatatatgtagcgacataaccaaatgagccaacatggacatgaatagagtctgaaccagttctaaaaggagctacttttacccccggaacattctgttgacctactggtacaaatattgaagtctccgcctttacacttgataacgatagtaaaccgatgacaaaggtaactaaaataaatgatacttttctcaatttcattttgcttttctcctagtagtacaatacattaaccggaattagtatataccaatttcatagagaaagcaagaaaaaacgctccttaagtaaaaactaaactcaaaaactcaattcttatccagcaccttgaaaggaatgtgggaataatctctgtgcgtttttaaaaattccaaggcttctttttttacctgtatgagattaacaccttgggcattggctccatagacacagccacaatagcactggcgataaatgtcatactcttcacacatttgaactgaacgctgatagcctccatttttcttaaagtcactcggaagatactgggtatcgtataatttctgcacctcaatcccaacagcattgatggtctgcgaattcttatgtggactgattgtcaaagccgaaccaaaatagtcaaaaccaagctcaactgccttctccgcagtcttatccaaccgataatcatagcaaaccttacaccgatctcctccctctggctcattggcgagatgctgagttttcttgaaaaattcctgagggctatagtcagcttctaggtagcctactgactgtccagttttctgattaaattctttgacaaactgggccgtcacggctgcccgccgctggtactccgcctttggatgaatattggaattcgcaaaatagatggttacatctgcatattgagtcaagtactccaatgtataggtcgagcatggggcacaacagacatgcatgagaatgttcggtcgaagccccgcttcctgccacgtgcttgccattttttgaaacactttatcatagttaaccttttgattcggtgatagagtcgataaaatctcttcaactttaatcatacaaacctccaaatatacattcattatactatatttgaagcctactgcatagatagtaataacgagggagagcgcttgataaggatccctatttccaacttaaaaaggtccctcggaccttgatataaagaaaaacgcctgccgacgtttctcatctccagcttaaaacgtggggtaacccacttgtaaagaaaaccgcttaccagcggttctcatttccaacctaaaacaacccgtcaggttggggacaaaccagcaacatgcattgctggttttcctatctcccgattaaaacagcctatccgaatataaaaaaactgcctgccggcagttctcattttcaacttaaaacgtggggtaacccacttataaagaaaaccgcttaccagcggttctcatttccaacctaaaaaggtcccccggacctttttagccacccagatatgcttttttgacttcttctgaggcgaggagttcttttcctgttcctgagaggacaacttttcctgtttctagaacatagccacgatcggcaatagcgagagctttgttggcattttgctcaatcaagaggacagttgttccttgtttttgaatatcttggatgatatcaaaaatttcttggataaagatcggagccaagcccattgatggttcatcaaggagcaagagctttggttggctcattagggcacgtcccatggccaacatctgttgctccccacctgaaagggtagctgcatcctggtttttacgttcttccaaacgtggaaaacgagcaaagatttttctcaagtttgcttggttttcttcacgattgttgtgaaggaaggcacccatttccaagttttccataacagtcaagcctgcaaaaacatgacgaccttctggaacttgtgataaaccgtccgccacgattttacgagcaggaactttttgaatctcatttccaaggaaagaaatcgttccagctgatggacgaacaagccctgaaatagtacgaaggatagaggttttaccagcaccattagcgccgataagggttacaacttcaccttcattaacctcaaagctaacatctttaacagcttcgataacaccgtagttaacggaaagattttttacttctaacattgccattaagcttcacctccaaggtaggcttcaattacacgcttgttattacgaatttcttctggtgtaccatgggcaatcaaacgaccgtactccaatacgtatatccgctccgtcacttccataaccaagctcatatcgtgttcaatcaagatgatagtaatgccaaattcttctttgattttacggatgagttgggtcaattctgccgtttcttgtgggttcataccagccgctggctcatccaagaaaagaattttcggttcagtcgcaagggcacgaacgatttccaaacgtcgttgttgaccgtaaggaaggtttttagctaatgtatctgcatctccatccaaatcgaagattttcaaaagttcaatcgcttttgttttcaacgcttcttcattcttatagaatgctggaagacggaagaaacttgcaaatacttctgatttaccatggttgccaagaccaatcaaaacattttccaaaacggtcatatttttgaacaaacgaatgttctggaaagtacgacctagaccaagcgaagcaatttttgatggtgctttaccgttcaaaatagtccctgccagagaaattgtcccctcgcttggctcataaacacctgttaagaggttgaaaagagtcgttttaccagcaccgtttggaccgataagaccaaccaattccccttcatgaagttccatggtcacgtcaccaacggcagtcaggccaccgaagttcttggttaaatcttttacttcaagtaatgccattacttaacctccttcttcttgagtagagccgctacgctgaattccttagttcccaaaagacctccaggacggaaaatcatcaagagaataagagctaatgaatagataatcattgaaatatcagagtaactcttgaggaatacgttcaaaataccaagtacaatggctgctacaaaggtacctgtgatagagcccaaaccacccaatacaatgataatcaaaacgttaacagaggtcataaaggcaaagtctttcggaacaattgtcccaacgtatcctgcatggagaccacctgcaatggctgccgtcatggcaccaaatacaaaggctgaaaccttaacaaatgttggattgacacctacagattctgccgcaatttcatcctcacgaacagaaattgtagcacgtcccatcggactgcgcaaaaagttaactgtcaccaaggttgtgatgattacaaaaatataaactaaaggccagcttgtaaagagtggtatagacataatacctgctgcaccattcgttacactaccaccattgataattaaaatacgaataatctctgcaacaccaagagtcgcaattgcaaggtagtcacctttcaaacgaagggttggaataccgactaaaagagctactgcacctgagattaacatcccaacaatcaaggcgatagcaaatccaccataagtcggcatcattttcccaagaatacctactgcataagcaccaatagccataaaaccagcatgaccaagtgaaaattgacctgagaaaccgacaatcaagtttaaaccaactgccaagataatttgaataccgatttgctgaacaatctggatgtagtaaaaattcagaatccctgctgatacaagaccttgaataagtccaaaaccagccaataagatagccaaccaaatcgcattaacttttaaattttgcttcatggttacaccttctctttcacatttttaccaagaataccacttggacgcaccaagaggatgatgatcaaaacagtatatacgatcgcatcgcggaaagtatcgaattcaatcacataggtgaatgtttcgatgataccgataacgaagccaccaagcgctgcacctggaataataccgataccgcccaatactgccgcaacaaaggctttcagacctggcgtcatccccatcaaaggctcaatctggttgtagtagagacctaggagaacacccgcagcacccgcaagagctgacccaagagcaaaagtaaagctgattgtacggtttacattgatccccataagctgagctgcatcgctatctacagagaccgcacgcatggctttccccatttttgtacgtttgacaattaattgaagtgcaaccatcaacgcaagcgatacaccaagaataatcaactggatattcgtaacagaaactggaccaaggttaaaagtcacagcttcgattgcttgtggaaaggcttttacgtctgctgtaaagaatttaatcatagtgtattctaagaagaaggatacaccgatagccgtaatcaaagctgctatacgcgttgaattacgcaaaggacgataggctaaaaactctataactacaccgagaatagccgtccctaccatcgctagaatgagagcaacaaagaaacgcgttccaccatctgcaataaaagttaaattatttaataggaagtaccccataaaagcacccatcatatacaaatcaccatgggcgaagttaatgagtttgataattccgtacaccatggtataaccaagggccaaaagggcataaacagaaccaagaatcaaaccattgacaagttgttgaagcataggttcaccaatctttctaaatatttttcgagctcaatagcattgttacattatacaaaattttctgaaaataagcaagttagacagagagtttaatcattaaaattacagaaaatttaaccaacccaaatttaaccaaattttatatccgcatgtatactattctatacattctgacaagtgaaaaagagggaattccctcttttcatccactattagtcaatagagatagtatctacagatgattcttctccgtttgttaaactaacaacataaactgatttaatgacattgtgctctttgtcaacagacattgtaccagtcacacctttaaagtctttcagagctgcaagattagccttcactgctgctgaatcagctgcaccttttgctgcttctgctgccatgtaaaccgagtcgtaagctaaagctgagaacattgatggctcttcattgtattctttcacataggcatcatagaatgcttttgctttttcgcttgctgatgttacaaatccagaaaggtagtaaacatttgatgctgctgatgcagttgccaattcagtaaattgtggtgagtcaaaaccatctgaaccaagaattggcttgtcaatacccaaaccgcgtgcttgcttcacaattgtacctgtttcattgtagtaaccaggcatgatgatcgcatcaaattccttatctttcaattttgtcaaagcagcttggaaatctttatcgccagaagcaaatgtgatttctgaaacgatttctcctgtgtatgctttcttgaacgcctctgctacacccttaccataatcagaagagttgtcaaagtaaagaacaactttcttagctgacaagttctcagtagcgtatttagccataatttgaccttgatacccatctgtaaaggttgtacggaagaagtattcttggacctcacctttatcgttcacaaccaaggttgtttgagttcctgaaggagtaatcataggaacaccagcagatgtcaatgctggaatagaggctgctgaagctcctgatgtagcagggccaatcacaacgtttgccccttcacttgccaagcttgttgcaacagtagctgcctctgctgtttcagacttgttgtcttttgtgatcacttcgatttttttgccgtcaataccacctgcagcattgatttctttcacggcaaggttggcacctttttcctctgtttgaccataagatgaaacagcacctgacaactccaagttgtagccgattttaaatgtatcacctacagaagaacctgcggctgaagtattggttgtcgaaacattaccacatgcagcgagtagagctgcagaggcaaatgtagcaagcgctactgcaaattttcttgttttcatgaaaactccttaaatctttcttaaattttacgatgtatctaatatactgaattatctgaaaattgtcaacaaaaaagaaaaaaattttaaaataaaaaattagcagggaatacatacctgctaattccgactatcctacgactgatggttcttcatctctccatagattacctacaaagttttggtctaattccttaatgtatgaaggaaccactttttttacaaaacgttcctttttcaattttaatatggtagcttctactagttcttgatccatatacaccaaaacatatcgcaagcgtttggaatggtaaacaatatctccatattggctgagtttacgtgcatcacgattgtagtgtaaatagacagttaagcaagtgcgatttttcttctcaaacatgtcttctcctctaaaaattctctttctatattataccgttttcaatgataaatgaaaagctccaactacctgtaaaagagttggagctaataggaatagtcagtactattacatatttgtcactgcttatttgacttttgtattgtccataatctggtcaataaatccgtaagccaaggtttcttcagctgacatccagtaatcacgttccgcatccttgtggatttgcttgactgtcttacctgagttgtctgccaagattttttctagcttattacgtgtttttaataggtgttctgcagcaatagccatatctgtttgctgagtaccaccaccagttccacccattggctggtgaatcatgtactctgcatttggcaacatgaaacgtttgcccttggcaccgcttgatgcaatgatggttcccatgctcgcagctgttcccataacgatggtttgaacatcagctttaatgaaattcatcgtgtctacaatggcaagacctgctgacaccgatcctcctggcgtattaacatagaggtaaatatcctttgtagggtcttgggcatcaaggaaaagcaattgtgcaatgatagagtttgccatgttgtcctcaactggtcctgtcaacatgataatacggtctttcaaaaggcgtgagtaaatatcataagaacgctcaccacggctagtttgttcaataactactggaatcataaaattactccttttcgagattttctgtacccattatatataaatagtcaaaattggtcaaataaaaaacacgatttcaggaaatgaaaaagaaaccagcagagctgatttcttaattattttgtaccgaacaagcggtcacctgcatctcccaaacctggtacgatgtagcctttttcattgagtttttcatccaaagctgctgtataaatatcaatgtctggatgtgcatcttgaagagcttttacaccttctggagctgaaacaagagcaacaaatttgatatttgaagcaccacgttttttcaatgaatcaactgcaagaatagctgaaccacctgtagcaagcattggatcaactacaaaaatatgacgttgatcaatgtcttctggtaatttcacaagatactcaacgggttgaagggtttcttcatcgcggtacataccgatgtgaccaactttagctgctggtaccaagcttagcaaaccatcaaccataccaacacctgcacgaagaattggtacgatagctaattttttacctgcaatttgtttctgaactgttttagtgattggcgtttcaatctccacatcttcaagtggcaagtcacgcaaaacttcgtaacccatcagcatcgcgatttcattaaccaactcacgaaaatcctttgttgaagtagatgtacgacgaaggatagacaacttatgctgaatgagtgggtgtgaaatgacttggaatttccccatgatgataaaacctctcttttttgttttttctattttaccaaaaaaattgaaaaaatgcttgagaatatggcaaatttatttattttttgaaaacgatagcttcaaaaggtctcaacatccctttattaatcgcctcttcgttttcataattgttcatgaaaatagaatattcttccacagctatagtataagcctgttcctggcttgaaaagtttaccaatatgatgaaatcatcctgttcatcatatttacggtaggccattaccgagctatttccagtctccatcacttcatattttccttcagacatacaaggatactctttccgaagagcaattaatttttgataggtataaaaaagtgattgtttgtctgcaagtgctttttcaacattgatgtctttgacagtatctcccaaagccagccaggcttgacctgtactgaagcctgctccttctgcctctgtccattgcattggacgacgagcattatctcgacctttggcatttatagaagtaatcaattcctccttggtgaagccattttcaatccgttccgcatacatgcgacgtgtttcaatatcgtccgcttggctaatatctgtaattggcgtattaatcataccaatttcctcaccttggtagatataaggtgtccctgacataaaatgaagatagatagccaacattttaccacttagttcacgaaatgcaggtcgatcatcaccgaagcgagaaatggcacgaggtaaatcgtggttattccagaaaagcgagttccagcctttaccaaccagttcagtctgccatttggagagaaccttatgcaaacgtgctggatcaagcggtgccaaatcccacttttctttcccttcctgctgatcaagtccgacatgttcaaattggaaaatcatcgaaaattcttttctgtcagggtgtgaatataactgagcattttctggattggcactccatgtctccccaacagtcactaagtcgtaagcaccaaaggttttctcatttaattcctgaataagaggatgaagagtcggtccatcggctgtaattaatttttctggttcttttccaatcaaatcaatcacatctagcctgaaaccgccgacacctttttcaatccaaaaattgatcatgtcccagatttcttgtttcagagcaggatttttccagttcagatctggttgcttaacagagaattggtggagatagtatttgttcagatgtggaacgtattcccaagcagagcctgagaaggtcgagcgtaattcattcggttcatcagcccaaacataataatcataatagggattatctggtcctttgagggcttcttgaaaccagaagtgttcatccgaggtatgattgagcactaaatccatgattattttgatattgcgcttatggccttctgcaatcagctcttccatatcttccatggtcccaaattctggagcaattccttggtagtcactgatgtcgtaaccattgtcatccatgggggactgataaacaggactgagccaaatagcatcaattccaagctcatggagataatctaatcggctgataatccctcgaatatcccctactccatctccatttgaatcttgaaaactacgaggataaatttggtaaatgacggacttcttccaccaatctgttttttgtatttctggcatttgattgatcctttctgtacaatcttattaatgtaagaaaaagaggtgtccccctctttctatataatcatattataactcaattgtggtaatttttccctcttcaatttcaacaatttcaaaggatttttcttttaggtttgctgttagacgggcagacacccctgcatcttgattattccagaaaatttccatacttgtttcatccaacatcttaacagagaactccccgtcgaaagctggacttgtattgcggaatttaaggagtttgaacaaggattgtacaactggccgttgcacttcctgctcaatttcttccaaatcatagtaatggcgattgatattgcgcccttccttacttgattctaaaagttcaatatcattttcgcctgctagtaaaccaacataataaatctgtggaatacctggtgcaaagcattggagaacacgcgccaatagataagcttgatcattattgccaagagcagaataataagtacagttaatctgataaatatccaaattattataggcttctgtactataaattttcttcacattggcaccttgtgcatacaaggcttcacgggtctcctctgtctcctcatccgtcagcaaatccttaacatccacaacaccgattccatcatgtgtatcaagagttgtaaattgcttgcgagggcaaatctccatccagtgaaccaggcgattgacatgaccagaatacaaagcgtggagaactagcattggcaaggcaaaatcataaacataataatcttgctcggcaattttctgctgaatggtgtagtgttcatgaatttctggtaagatttctacatcttttggtgccaataactgacgtggaaaatggagcatttcccaaatatcaggctccacaaagaaacaattggttccgatttttttattggcataagcaaaggcgtccaaacgaataatcgaagcaccatgctctgccaactgttccaaattttcttggatgaaacgacgggttgtctccgttgtcacatctaaatcaatctgctgttcatcaaaggtacaccacaccttctcttcactaccatcagcaaatgttgcaattcgataaggtgcgcgaggtttacgcttataaatcaaatcaacatcttcttgcgttggctcaccatttggccaaaagtttttataacgaataaacaaatccgcataagctgattcatctttcttttcaagaaaatcaaggaaataaggagattttgctgaaatatgattgatcataaaatcaaacatgaggtaatagtctttgcttagtgcttcaatatctgaccaatctccaaatgcagggtccacctttgtataatccattggcgcaaacccacggtcacctgatgatgggaaaaacggcagaatatggatacctcccacaacatcctttaacggcccctcaagaacttttttcaaatccttaagattcttgcctaaactatccgaataggtaattaacatagcttgatttttaattttcatagactttctcctttgtaagccttttcttttttgttattttataaaaggttgaactagtcaaccttagtaattatttgacagaaccacttgtcatacctgaaataatatgtttttggaagatgaggtaaacaagtaagattgggataattcctacaacataggatgcaaatgatgggccatagtcactaaaatacataccttggtagttgtattggaaaagaggtaaagtccacatgctttgatcacggttcaatactagcaaaggcaagaggaaatcattccagacccagagggcattgataatcaaaacagttgcatgcatgggtttcatgagtgggaaaatgattttccagtacatggtaaatttatcacagccatcaatagctgccgcttcatccatttcttcaggaacaatggtcttaatatagccgacgtagaggaagagggcctgaggaactgcataggtcaaatatagaataatcaaaccgacaatattgttcaaaccaaggcttgacattaatttggtcattgggagcataatcacttggaaaggtacaaaaatcccaataatcaagaaaaagtagataaagttaaacactgtctggcgtttcatttgacgggctacggcgaaagctgccattggaataacaagtagaatcaagccaacagctacaatcgtaatcaaggcagaattgccaaaatattgtacaattccatcattaaacaagcgttcgtagttatttaaggtgaaattttcaggaagaccaaagaaattgctggtaatttccttggttggtttgaatgagctgataatggtcacgagtagcggaataaacatgaacaatatcccactaaagagaactaagtaaacccaccaatttttctgtttttgagtattcatgtctgtcctcctaaatttcaaatttcttcgaaattctcatctgaatcaatgagatgacaataatgaagatgaagagtactacagccaaagcattggcataagagaatttgttgtctacaaaggcatagttgtaaacgagtaaacccaaggattctgttttgccgtctgggccaccacttgtcagtgcaaagataaggtcaaatgctgtcaaacctgacttcattgccaagatgaaaaccatactgatagatggtaataagaatggaagctcaatgttgaagaactgttgagaacgacttgcaccatcaatagctgctgcttccttcacatcttctggaatactttgtaagccagacaggaagatgatgactggcatagccaatccttgccagagagccacaaaaagtacagctggaataacagtattttcttgtaccaataagttttccatcaaccaatcgatatgaaggatttctccaatctgtgtaaaaccatagttgaacaattggacaaaaatcaatcctaaagtgactgtggatagcactgctgggaagaaataccaagttctaaagaaaccaactgctttaatcttacgattgaggagactagccaaccaaatccctataacaatttctccgatgaccaaaccaatggtgaagataatggtaaaagtcatggaagtataaaaatcaggattttttaaaatatctaagtaattctgaataccgattagtttgaaatcagatgtcaatccattccaatccgtcaagctataatagatacctgtaaatagaggatagaagaaaaagattaactgtaagccaattggtatggcaacaaatagatagggccaatatttggcaataaatcctttttgattcatcatggtactcctttttgataaagttatagttgcttagtctcagttcaaggaatcccatagggttactaaaactgacactaggcaactataaggaggctaggctacaactagcccctgcttatagttttcctggattattttttcattggatcaaagaatgcgttcagttttttcactaattctgctgagttaggatttttaaccatttcaacagtgatgttccagaactcctcttctgattcccattcagattgcaaccaaactacgtgtttgtcagtgaaggcatattgtgtcactccagcagtttcttcaaacttaccttctgtatctacaccttcaactgaagttggtgagccatctacatcatagtatttctggataacttctggacgagagaggtattctaggaattttttagactcttctgggtgctctgtatctgctgaaatagatagtgcaagatcagctgcaccgatggtatagtcgccaccttctttatcaccagggaatgtaaacataccatattcaaattctggttcttgttggtttacagctgtagctgcccatgtaccttgtggaagcatgagagcatcacccgctgcaaaggctgccaccgcatctgcatagagcgcgcctgtcgcccctttttgtccattgtctttcaacaattgcaagcgttctaaaactgcttttgttgtagcatcatcttgaatcgctccctttgcactacgaatcagaatatcttctgcaccatcaaatccacccgcaacagttacccaagctaactgatggtagccgttcaatgaccaagcatcgttcaatgaaagagcaaacggtgctgcactgccatcagccttgattttgtctaccaaagccacaaattctgcataggtagttggaacttcgagccccaattctttgaacttatccttattatagtaaattccgtaggcattagctgtcaaaggaagggtataatttttttcgttaacaagatatggtgttacagcaccatctttcaaatgatttaatcctgcatcatcaccaatttctaggaaacgaccatccgctgcgtatgctttgaagtccgcattttgtggataaatgttgatgacatctggcgcttcgttatttgccatacgggttttcagaacagttcctgcatctggtacatttgaaaatttaacatcaatcgtaggattttccttttcgaaatcatcaataatttcctgaagggtagcttgcatttctggtttttgtgaaaaatattctatttctaccttatcgctactacttgcattcccacaagcaaccaaaaagctggcaaaagcacaaaccgatgcacattttaaaaatgttttcattttcattataaaatcctcctagattttgttaaaaatatattgtacactaaaataatctttttgaacatgtggcattgtaagaccaatgttcatcagttcatccccgtagaatgtctctcctaattgtgggcattcatacaaggcatctgggtctaaccccttcaaccgaacatgaagcaaaggcgcttctggcttggcaagaatttttacaaatgtaaagaccacttgattcttatcttgactaacataattggcagcccaggtattgctcgtctttttcagacggtagagctgaccgaattgtatagtttcacgaatggagtgataggtttcgatttgctgactgatttcatccaattccttttccgaaagtttcgttaaatccagctcgtaaccaaatgctcctcccatcatagccacattgcctcgtgtagcaagaggtgtgatccgaccaacctgatggtttggaacggcagaaacgtgtgcaccaattgaggaagggggataaatcaaactagtaccttcttgaatagataagcgctcaatcgcatctgtatcatcacttgcccaagcttgcggcatataatacatgattcccaaatcattacgacctccaccgcctgcacaggattcgaaaagaatatccgggaaccgctttgtaaggtggtctaatacacggtagagacctagcatgtaacgatggtggaactcaaagcgctggtcatttgctaaaccttcaggaatattggtgatattacggttcatatcccattttacataagaaatattggctgattctaatatggaagagacgctatcaatgatgtagtcacagacttcctgcttggtcaaatccaaaactaattgttctcggctgtagattggtaagcgtccttctgtccgaattgcccaatcaggatgctcacgataaagatcgctatcaatagaaatcatctctggttcaaaccacaatccgaatttcataccaagctcatttattcgctctgctaaaccattcaaaccatttggcaacttatccaaattgactttccaatcgcccaatgaactttcatcattgtttcgtttaccaaaccaaccatcatccagaacaaacaattcaataccagctcgacttgcaacctgagctaactgtaaaatcttttcttctgtaaattcaaaataggtcgcttcccagttgttgattaaaatgggtcttggtttgtttacaaacgatgatcgaatgaggtgttttgtgataaagtgatgactattttgtgtcatgccagtaaatcctttatcagtatatgataagagaacttctggagtttgaaaccggtcatccttatccaattgccatgagaaatagtgactttccaatcctagtcccaaacgactggtttccatggctgtcgtttcgacaaatgctgtaaagttgccgctataaacaaggtgggctgcataaacatcgcccttgtcctcacttgcatcgggtgaaactagtgctaaaaagggtgttcttgagtgacttgaagcacctcgaatgctaccaatcgaatactgaccttttgtcaatggggtctgtgtccactctttttcataagcataacgtcctgccaagctgtgaacaatgaaatcctgatgtggaaaatcaagcgttgcagacaagaccttctctagtttgcatggatatttgccagtttgaattgtagctgaccgtgcgagataggaagcttcttcaaaaacagaatactgaagagttacggtaatatctgtcaactgatcgtaaagatcaatttcaagactctctacctcttcttgatttccaaaacttgctggtaatcccctcagttcttttttccccttgtataatcgatactctttgtattttaggtcaagagtgactccaaattcattccgaacatctaatgctgaggttctaaaatctcccagaccattgctggaatattcgagtgggaggacatccaatgagtatgtcctatccccagtaattggactcggagaaaacgatcgatctaaatatgttattttgtttccatcgctaaatttttcgatttttttcccaaaataacgatgaaccagatcgcctgtttccaatacttggatgatataagagaattctcttgttttcaggtgaaaaatctgtttttcattataaatctcaatcacattcatctctcctatctcttctttatggtcttattgtacaaaatgaaaacgctttatttaatggtcttttgtatttaaaacatgttataatgtttcctaggaggattgaaatgaatgttctaaatatctataatgaattggatagtcataattttgacctaaatgtagaccattacggtgccgaacaatgtgacaagggctattccttcggtcctactatccgtgataattttgtcctacattttattacaaaaggaagaggaaaaattcttgttgacggaaaaacaagctatcttgctgcaggtgatttgtttattctgccaaaggatgtttccattttctatcaagctgatgatatagacccgtggacctatgtatgggttggttttagtggttcacgagcaaaagacctacttaatcaaagtcaactgctagaaaactactacctccactccaatctagagtcaccaattctaggctacatgcatcagattaaccatgttcagatgcatcccatcccctctatcacagaattggtcttaattggctacctcaaccaactcttagcagcactcatagaggaatttcccagtgaaacattaattaagcctgaaacacaaaccaagcactatgttcagcaagccatcaagatgatccataaccactatgcccatccaattaaagtttctgaaatagcagattttctagctttaagccgaagctatctctataaaatttttaagcaggaaactggctattctatcaaagattatattttacaagtaaaaatgaatcgttcttgccaactattagaagatgcttctcggagtatcactgaaatcgcctattctgtcggataccaagaccctctcaccttcagcgcggccttcaaaaattatttccatataagcccgacagaatttagaaaaacacaaaaaaataaggattaggtgattttactcacacctagtccttatttctttatccaaaaaccttaccaagtcgctgacaggcttcttcaatcatgttgaatggtgctgctacattcagacgtgcatggtgcttaccttccttaccaaaggtcaaaccatcattcaaaatcaacttcgctttacaatgaagaatatcaaagagctccgcatactctaattcataggcagaaaaatcaagccagatgaggtaggttccctgaggcttcatgaccttgatccttgtatgggttgtcaaatactcctcaacaaagtctatatttctctccaaaataaccttcaactccttcaaccactcatctccataagtgaaagcagcttctgtggttaacaagccaatcgttggaatctcgtgctgattatttatcaattgacgcttagcgaaagtcttgcgaatacttggattttcaatgattgcaaagctattttttgtaccagcgatattgaaggtcttggtcgcagatgataagatgattgaaaactctttaaaactttcatccactgtgttaaaggaataatgcttgtgaccatacaaggtcaaatcttgatgtatttcatctgagacaaggataacaccatgtttctgacaaagacgtccaatggccaacacttcctctcttgtccaaactctaccacctgggttgtggggattacagaaaatatagagtttcacttgattctctacaatgtccttttcaagctggtcaagattaagcctaaaaatactatctacatcaactagtgaattggtcaccaactgacgattgtttaattttacagtccgcgcaaagggtggatagacaggtgtattaattaggactgcatccccttcttctgtcaaagattgaatagccacagataaggcaggaacaactccttcaatgagtagaatagactctctttcaatcttatagccatgctgtctatcttcccagtcaataatagactgatagaggctgtcactagcatagggataaccaaaaacgtgatgaactgcgtagtcacggataacttggcgaatttctggtagaggctcaaagtccatatctgctatccacaagggtaagagttctttatccgtctctacttgtctccatttttccgcatgctgggatagacgattcggactatctataaaattatactgtgtcatatcttatccctccaaggctgtctttaaatctgcaatcaagtcttccgcatcctctataccaatagacagacgaagcaaatcatctgtcaaaccgtaagaatgacgggtttcagctggaatgtctgcgtgggtctgagtggctggataggtaatcagactctctactccacccagactttcagcaaaggtaaagactttcagggtgttgagaatatggggaatccgactttcatttaccaccttaaccgaaatcatcccaccttttcctgtgtagtaaacttgcttgactgctggactcttctccaaataggcaacaattttctgagcattttgtgtcgcccgctccattcgaagcgagagggttttgagtccacgcatgagtaagtaagaatccagtggagatagggttggacccgatgtattttggtcataaaagagcttatcatatagggcttgatcattggtcatcaaagcgccagctagtacatcattatgcccagataggtacttggttgctgaatgtaggacaacatccgctcctagaacaagtggattttgataaatagggctgtaaaaagtgttatcgacaatcaccttaacacctttggcatgggcgatagccgaaaccttagcgatgtcaaactccaccatgagtgggttagtcggtgtctccagataaacatagtctgtctcttcggtgatggctgcaatcagctcctcctcggtgtttgcataggtaaattgaaatctaccgatactctcttgctcattgaaccagcggaaggaaccaccgtacaaatcacgcgccgctaccacttgactccctacaggaaaaccattaaaaagtaagaccagagcagccattcccgagctcgttgctagggcatagtcggccttttcaatagctgccaaagtcgtctctagactggcacgtgtcggattttttgttctcgtgtagtcataacctgtcgattgaccaaactcagggtgttgataggtcgtcgaaaggtggataggggaaatcaaggcacctgttctctcatcgctattgatgcccgtatgcgctaaaatcgtatcaatcttataatctgtcataacatctactccaatctaacttacaatatagtctagcatgaaataggagatttggtgtgaaaaatatccaaaaatacttatagaaaaatagcaagctttgttatagtttttctttataacaatatccatactggatctaccaataaatacttttaaacctataatttatttgatataataaaagaaagagaggtgattgtcatgaaattccagtttaacaagcatttctatcggtatagtgccttctattctatgattttttggacttgtttttttctgtcagacattttgctagacccttcccaaactcctgcatggtatagcctactagcctgtctgattatttttatcaatgccatttgggtattcttcttcaaagaagaaaaggagctcactcgcatgggttacatcttctatatcggattgattgtagtgattgtttatctgagatttattttaggtaagtagaaaggagtttactatgtctaagaaattcaataaagcattctatcggacctgggaattttacttgtctcttgcctgtatcctacaagtgatttatgctgctgtaaacggaccgttttggtttatccattttctcaagcttggagtcggactttatgctggttatctagctttctttaagtcacgtagctggataaaaaaaacatggcaaatttatctgacgattggattgattgctagttggataatcatttccttctttgtattgtgaggattttatatgtttaaggaatttaataaagaatattatcggagtttgaatttttatctgatgatattgttgtttctaggaagtatcggggagtggctaaataagggacctagcctctggcttgcactcttgctctttgctactgttggtactgcccgtagtgccttttggtctaaagaatggaccttaaaagcaaattggcaaatctatctctgtatcgccttcttgcttgttggagcttgggtagaattttttgtttaagagttgggagtgggaaagaactcgactaagtcaaaaagagttcgtattcccacccccgcacagttgattaggtcagatttggagtgtaaaacacgaacaaatctgccaatcaaccactgcgctgagatgttgacacgaacactgagaagtgggccagggctttttgcccagcctcttttctttcaaaataaacagtgattttcattcaaagatggtataatatacctatgcaaaaaattgatttactagacggagagcggattgaccagctcttctcgacagatgttcagattattcaaaatcgggaggtatttagctactcgattgacagcgttcttctttcgcggtttccaaaaatgcctgctcagaaggggttgattgttgacctttgtagtggaaatggggcggtgggtctctttgcttctacacgcaccaaggctcagattattcaggtcgagttgcaggaacgcttggcgaatatgaaccgccgctccattgccctcaacggtctggaggatcaggtttcggttatcaatgacgacttggcaaatctaccccaatatgacctacggtccaaggttgatttgatgctctgcaatcctccctacttcaaggtggataaagagtcaaacctcaatgaaagcgagcattatctcctagccagacatgagattgcaaccaacctagacagcatttgtcaggtggcccaacaggtgctcaagtccaatggtcgcttggccatggttcacagacccgaccgatttttagatattttagacacactaagaacctacaaattggctcccaaacgcatccagtttgtctatcccaaggccagcaaggaggccaatatgttgctgattgaggctatcaaggacggctcggtggacgggctgcacatcctgccacctctggttgtccatgaggaaaacggcgactatacacctgccattcgtgagatttattatggaaaataaggcctacttgtatgttttggaatgtgccgacggaagtctttatactggttatacgactgatgtggagaagcgacttgctacccataatcgtgggaaaggggccaagtacacccgcgcacgcttgcctggcagcctgctctatcaggaagactttgacagcaaacaggaagctatgtctgccgaggctttgtttaagaaacgcagtcggcagagtaaattagattatattgcagaaagaaaacaagaaaatgcaaaataaaaaacatatccaccgccttcgcatcatttggcatatcttgagagtgactggttttgccacttttctcacttcctttttcagttttatctttctagcagctggtttgctactctggttggagcctgattttaccagctacggtgatagtttatggtacagctttgtaacggcgacgactgttggctatggagatatgctggtcaccactgcttttggacggattatcagcattatcttagctatttacggcattctctttttggggagcctgtctggattagtcgtcagctactataccgaggtcagcaagcattattctttagcaatcaaacaggacaagcaaaaaactggctcttaggaaccagttttttaatagctttccaaaatctgatcaattttagccattgcctcttcaaaaataacctgagactgacttggatcggcagattgcccttcgataaagacctgatgaatgtcttcaaatccaagaaactcaaagatagacttgatatattgggcagctggatcttgacctgcataaacaccaccattggactggatgtgcaacaattttttgcccttgaccagaccgatagagccctcaggtccatacttgaatgtcagtcctgcaacgttaatggtattgatccatgacactaattgacttggcacattgaggttccaaaggggattgaccacgacaatcttatctgctgcaagaaattgttgggtcaaggcattgtagcggcccaactgctctgcttgttcagggctgatagcttcgcctcttttagctgctcccatagcctctaacaagggcttatccaaagctggtatttggtcctcaaagacatctactatttcaatccgatcttctgggtgcaaactggcgtaccgtgtttgaaactcttccaaagcccgcaaggcgtaggacttttgtgcgtcaagtgggtgggcttttacgattaatagatttgccattggttctctcctttgttatccgttattactaattattgataaatatattctactctttttgatttgaaattcaaatcatttgctcgaagcaaaaggctggtctcccagcctctgcttttttagattgttttattattttaaataggtgtaagcgacacagtccaggctatcaacggctgtaaagccaattgcctcatagaaagaccgtgttttctcagtattgtccgtcaagagatgaagctgataaatacccggaaagtgggtaacggcctgctccaaaagctgacgcccaattcctcgtcgctgataggttggtaggaccaagatgtcctgaataaaaacgattgaatgcccgtcgccaactgctcgcaagagacccactagacggtcaccgtcaaaggtagcaagaacgagcagactatgttccaaggccttctctagcatttctggacggctagtatatcctgtccaacctacagaagcatagacgtcaaggacagcttgaaaatcgagttgaggattttgtttgtaagtaatcatgtctttctcctttgtattgttttttagaatacaaaggctttgtccattgttaaaacgcccatggtctttcctcctgttttgctacatttagtataacaaaaactgctccaattatgaagcagttttgtaacgacgataaaaataatagagactcaaggttatgacagatgtaccaaacaaaatcagcacaaggatagatagggttggtgagcctaatagactaactagcagcaataacccaccaataatgaagagatagcctgactgctttcttccctttcgttctatttcattggtcttgctatccaattcctccttgggtaaataattccctattaccatatagccgatagccagcagtccaatgacaagcctacggtaatccaattctccgcctaaattataccagagtaaagaaacttgaatgatgagagccagtagcggaaaaagccatttgaacactcgaatgactggtgttttccctatccctttcacatcataaagcacacaaataaataggtgaacacaaaagaatagtagcggtgtcaaaattgtcaccatatacttagccatagagccatttggctcaccatttacgccaaaatgcgttaccatggtatctggcaatgctccatagtaataaatcgtcaataaagcaatcagtaggaatataccagaagttgcaaataaggtttttatgtcaattttcttcatcttgttgccctccaaaacttgcaatccaaaccaagacttcttcaaagaccgtatagtttagacgataataaataaaatttttctgcttttcctccaaaattaatccagcttttttcaaagtggataaatgatgagaaactgttgctcctgttaattgaaattgttctacaatttccccagcagacttcggccccgacttaagactatctagaatttgcctacgaataggagcagaaattgccttcaaggtttcagacaatcccataataagcctccttgtccatctatttagaaatatttctaaatagaattatactctgtttttattgtttgtcaagaactatttcgattattttctaaatagatttcaaaaaaaacagaccactctttatggtctgtcaaatccggcttatctctcccctttattgcgaatcacaaagcctgttttcttttcacttgatgtgcgttggtgtggttttttgttgtcttgacggcggttatcgcgcttgaacttgtcatcgcgacggttgcggtcgttacgatcaccacggcgtcctccgcgatcacggtcgcgacctccacgtccacctttacccttggcttgaccaggtgcaaacttgaatggtaatggtttttctcgcgcaatttctacctctggcagactttctggatcctgaacagtcaaggtcaatacataaagcgctaactcttcaggggtaaattcagccgctaactgaatagcatctttcttgaacttatcaaaattgttacggatggtttcatccgccatttcacgctcaatcttcttcaaagcaacttttttcttggcttcaaaggcctcttcagctgtcgctggcttgagccctttcatgcgtttcttggtcaaatcttcgataatagccaagtagcccatctcgtttggcgaaacaaaggtaatagactgacctgattgacccgcacgacctgtacgaccgatacggtgaacatagctttctggatcctgtggaatatcgtagttatagacatgcgttacaccagaaatatccaaaccacgcgccgcaacgtccgtcgcaacgaggacatcaatctggtcatttttaaagtcacgaataacacgaagacgcttattctgatccaaatctccgtggataccctctgcacggaagccacgcagtttcaaaccacgagtcaattcatcaacacggcgcttagtacgaccgaagacgatagacaattctggctggtcaacgtccatgaggcgtgtcatggtgtcgaatttttcatgttctttgacacgaagataatattggtcaacattgacattagtcaattcctttgctgcaatcttaacgtgctcaggctctttcatgaatttgacaccaatacgcttgattggctctggcatggttgcagaaaacagaagagtttgacggctttctggcacacgttcgatgatggcttcaatatcatccaagaagcccatgttgagcatttcatcagcctcatcaagaataagggtttcaacaccgtcaagcttgagagctttacgtttgatcaagtccaagagacgaccaggtgtaccaacaacaatgtgagcaccagaacgaagggccttgatttgtttttcaatgctagaaccaccgtaaacagagcgaacttttactcctttttcacgaccaaatttgaaaagctcttcctgactctgcaccgccaactcacgcgttggggcgataatcaaggattgaattgcttgattgtttgtatcaatcttgttgagggttggcaaaccaaaggctgcagttttccctgtccccgtctgcgcttgaccaatcacatcttttccttccagagcaagcggaatggtctgctcctggattggtgacggcgtttcaaaaccagccttctcaacggcaagcaaaatatcttctgataattgtaaatctgtaaatttcaatgtattctcttttctaaaaggcagtgcgaagctaccttatctaacttttttgtaacaagatatcagggtcgaaccactgatattggatttgcaacttaccaagtataacacaatctaacaataatagttaatatttacctttaaaaagtcaataatacgttttcatgaggagtccatcattttatagacatttgaattagctttgatacatcgatactttcggtttgccctactctagtaccagctccttgtctgaaagttatactcttcgaaaatcaaaatcagacgttgttgacttgatttgatgaacttcagttctatctgcatctgcgtcgcctagtctgtttttgattttcattgagtattaattcattcgactataagaaaagagaaacctagttatacatgcacaactaggtttctcttgtatttttatttatgattattctttttcaatgcttgcaagaaccagtccaaacttttactgataatgacaaccattaccaatgtccaaaatgtttttacaagcccaattttaaaagccaaaggagttaccacaaatacatcaaaaatgagaataacggtggaaatcttccatttgaaatatttattacacaacaatgcaataatatcacttcctgccgtggacccgtttccataaatgactagagccattgataaacctgtcaccaatcccgccaagagagcagagggaatcaggggcaaccattttatttgcagaaaagtcgtataatgcatggttaaggacatagtagcaaccgctaagaaagtatagaaaaccgttaacttactcaaaaagcgataggctaatacaatcaaaatcccattcaaaacaaaactggacagacttgtttcaatccctgtcgtataaaacaaaagtagggtaacaccagtaatcccaccttcgccaaattcatgtggaatgatgagcatattcaaaacaagggcatataggattgccccaaaacatatcaataagcagtctctccattttatctgcgtcatattctctcctcacaaacagtccaccttagtatatcaaaaaaagcagaaagcggatagccactttctgtacttttttcctattttcctaagacagctgaagccagagctttttgaatagcaatgacactcttatcgctcttaaactgaagaatttcagcaggttcaacagccgatgaaatccatattttcagctcagcatctaagtcaaaatgaccagaggtttctaccgtaaaacgtgaaatcgagcggtaaggaatcgatttataagatacctttttcccagtcattccttgcttatcgaccaaaatcaatcgatattctgtaaaaacaatcagatcacgaaccagactaaatgccatctcaacctgttcattatccagtagaacatgctccaattcctgttcaatcttatcattatccatttgcgaggcattgcctagtaaacctgaaaatagtcccataatatgactcctttggtatttttctatagtataacacaaaaagctactagttgactatcttaggcactaggtctttaccaaacatgagaattactcgcttacctttgcttccttatcaacttctttaggttgattgttctcaatactgccaccttcaactgctggaaaatgttctgcaatcgcagatgggatcttctgatcatttagatttaattcttccttcggaatgtgattttcactcacatcaattgttttcaaagtcttattcggctctgtaatggcaagtgtttcaatatcattttttgaagcattcaggtcttctaaggctttgtaatcattgactccttctaaattcttcaattgattatctgcaacatttaatcgaacaaccgattcttgtttaccctctatttccaaagtcttaatttgattcccctctacatccagatttactaatttttcattttcttctatcccttgtaattcagtaatcttattattcttaagagtaagactagttaaatttggattgttttttacaaactgaagatcttttacattactttcattagctgtcagttcttctaaattctctgtttttagagttgatatatccaattgaggattctgtgatatatacaaacgggttaacttcttcttgttttgaagcgcagataaatctgtgatacgattattatctaaactaacagctgtcaattgtgacaaatctgctaatggggataaatccgtcactttattatgatctaaatttaaagattccaaagcttttaatttagctagaatagtgatatcttcaatgtcatttcctgcagcagaaactacttttaagtttggaaattcttccaaaaagcccaaatcagaaacaccattttgtgataagtcaattccctctaatgttggaatttctttcaaaaattgataatccttaacgcctgtgctagtcatccataattgtttcaattttttaaattgcaagataggttttacatcatcaattggcgtaaaaccaatccctaacacttcaacatttggcatcaagtccagaccggctctctttagcggatcttttcgctgaccaatatttagatattttaccgtttttaaccactctctcatcttctcggaatctgtttcattagatgggaaaggagtatcggccgtagcatgcaaaatatcttcaataatctcatcatcaaaacctaattgttttaaagtagccattccaattttatcatgagcatgtgggtcaccgtgagggtcttcgattggttttccaacttcaactttctcaatcaagattgtatgagaatggtcaccatgagggtaaacgaaagcaggtcctgcatctgtttctatcaccttgatttttgcttttgaaacatgcaggttttcggctaggtagctctttttagcttctcgttcttcttctacacttgagttaggtttcccaccttcttgtggtgacaacggaatttctacattaacttgagtggaagttgacgaatggtattctgctctagcagtctctaaatactgagtaggaatataagactcccacggacttcctatcaaatgactgtacggaagtaaatgagtatgagtaccatggccaatgagtaaccctaacgctgtttgaccttggactccgctaccatcaaaaaggaaaccgtcgcttgttggataatcaatacctgggaaagctttctttgaattagactgagtggaagtatgccctttttctgtggtagacttgagtgggacgaaattatttcttgtggtcggagtatgcaacgaatgattatcaagaacagtaatctgtcccttttttccaatggtctccccagtatttccttgtccgtattgcaaacttgatttccaaatataatgataatgatctccatgacgtaccgtatagccattcgcatcttcagccactacatccttcggatcaaatacataaccatcatcaaaagtttgtgatagcttcgcttgctttgcgttggaatgcgagctggattggctattctcaatgtactctttgggtaccagataggaccatttgctttcttttaaatccttatagaagataaaatgtgaatgaccattatgttctaagaccagtccctcatccgtttttgaaagaatttgaccttcattttcaaaaagaaatccatcatccgtaggataatcaacaccagctaccccttttttagcttgagaagtaggtttcttttgatttttggtgagtttcttagcttcagaaatagaaattacattagcatctttatccttgggatagtagaagtactgctcatttacttttataatataacctttctctagctgatactgaatatcttctttattcaatttataatcagaatctggaagggtatcttttaaaaagtgtgccgcatacgggatcggaccttcaaaaaagtatgactcttctccatatagacgcatatagccattagatttaatttcagacactacaatcgtattttcatctacttttgagatattgctactttgaacatcttgatgatttattgcagtattctctgttttttggcaacccgccaaaaaaagatgacaagataggataatgcctgtcaaggcaaataaggttgttttctttttcatttttgtcctcctaagctcattaaccagttaacaattaactagtatacattttatttttgatttttgcaagaaaaaacaactgacaatgattgttcgtgaataaattttccattccacgacaaacgcatgaaaaatttgttttataaaccatattttcacgactgctgtcagtttttagtagaaaaaatgtaatataatagccttggaaatgggggtatccttgttaaagtgcaagttttacaaaaaccttaaaaaaatgcatacaacaagaaaatagttacatacctttttcttcatgcggattgcatgtttccatccctacgatcattgacaaagcaaacaaactatagtatattaaaaatagggaaataaaaggagaatatatggaaaatacatctactcaaactttcgaagaactcgttgcggaacagaaaaagaaacgtaatcgcgtccttagaattattatcacactctttaccactattatcgtattttttgcctgtcttgcattattcaaatacaacagtggcaacattagcggtacgtggcgtaattcccaagctgaacaagatattgtcgaaaccagtatcaaggaattgcaaaatcaacttccaggtattgataaaacgtggattgacgcaacttatacgatgacagtcgtagataagaaagctgtcttcaccgctacaacaagctttgatattcctaaaatcgcaaaattaaccttggatcaagcttacaaggtaatgttagaggaagcacaaaaagaagcaagttctctgggaatttccgtagaagaatacttaacaaccgctctcggagcagattatgaaaagcaattgaaatcatttctacctacacaagctgaggcggaaaaagaatttcataagtaccaagacgaatatgctaaagaactaggtgccacatacaatcaagaaactggtactatctctgctacctttttcgaaggagacgtcgatcagctcttccatactgtgaccattacaaaaattaatgacgcagcaatcaaacagctgactacatacgatatttccgtaaaagatattatttcctattctcgcaagggaaataccaccattattaacggaaatgaagaatttactttagaaaaataataaaaaaagctgggaaagtcatccctgatggttccgacctcacccacagaataatgaaaataaatatgaagccctcactaggtgtataatcttagtgagggctttgtgcttgatgagttaatgatgttagtcatcgccggaaaaactaacccactctattgacgagctctaaaaaatatgcaatagacatgagcataagaactagccaataaaaacacagatagattcaagctaattttgatgaaatacagccgaattgtctgtgcttttatttttgtctctactatagataggacaacattgtgacgatatttgaaagaacttgtactaatactcaatgaaaatcaaaagtagcctaggaaacgaagccgaagatagaactggagttcatcaaggcaagttgacaacggataattttgattttcgtagagtataacctcctgtttgtttcatcacttacagtgtagtccttctgaccttttttgcatattgaatttaactaatgtcaccaatataaattattttctcttatataaccttttacatacctgataaagaataggtacagcaatgatggtcgtaattgcagtgccataggttcctaaaatcctacctaaagcagctaaaaataatactgatggcgttagtccaccgactaaactacccgtcaatgtgtacttcaacaggttcaagataatttttgtgagggctgcaactatcccaaccaacataatatttgatagactatcgtttgcctgtaggaatttctcataaaataagtgtaggacaaaacagacaatgagtgattctagaatggtaatccaagcaacggaggcatatcccgacagtaaatcaaagattcctagaccgagtgaggctgccagcgccccttttttggcaccaaagattagtactcctactaccaccagagcattgcctagatggacaaattgactcccaaaaggaatacgaataaagaagacaaccacacaaataagggctgcaaataggctaatttctgttaattgacgcaattgattctgtttcataatttctcctttaatatttgaaatgcctgctgtaattctgctagaaaaggttcaaaggaaatcccaaatttcaagtctctatccaaagcaagggtacgctctaaactcttatcgataaaatctaaagctagagggatagcttgatggagattgatttgttggatggttgctacagccaacaaggtagatagaatgtcacctgttccaaagaaatttgctggatattttttagacatataggtagttatttcccctgtttcctgctgaaaataggctacacctatttggctatcatcaaaggaaatccctgtcagtacaatatctgcggatacctgctctgctaaagcttccagtaagtcctcaatatcatgaatatcgtaggaatctcccaaatagtttctcccagtcaatagagaagcttctgttatattcggaagaatgagctgggccgactgagtcaattctttcatggcctctacataggatgatgtaaaacctgtatacagtcttccactgtcacccataatcggatctacaatcaatggtgtctctgtttgtttagcatacatagccaattgacttagttgctgaggatttctacagtagccagacaagatgcctgccaactccaaattcaagttcttccactgttcaaaataggcttgattcaagtcagtcatatcttcaatgacaacatctgggaaaccgcctgtgtgtgaggataaaagaactgtaggtaaaagcattgtttctacctgacaagctgctgcaattgggatgctagttgctagtgcaaccttaccaacaccaggtaagtcgttcgcaagcaataatcgctgcatgataactacctcctaaattatttttcataaacaaaattgtaaaggattatcatacatttttcaatcttacatatccgcaactgtatggggacagatagctgaaaccttgcaacaccaggctcaaattattacataagaaaaacagcaacaactctttgctactgtcatcctcttcaatgtattgttgtcaaattctgtttaatatttctccagaaaggcaatcagggtctgggcagaacgttctcctgcttgaatgataaattcatcaaaggtgatattggcatctccctgagctgtgtcactcatggcacggataaccaagaatggcttacctgtattgacagctgcttgagcgatagctgctccttccatctctacggcaaggacttctgggaaatgagttttgattgtagcgattctctcctgacctgcgataaaactgtcacctgtcacaatcagacccacatggctaatcatttcctgctctgctaaaacggttcttagctgttctaacaagacttggtcggctggataatacaattcctgccctgccatttgcccgtaagcatagccgaaagccgtcacatccacatcgtggtaagccaattgattcgctacaaccacatcaccgatggcaataccttcagcaacagctcctgccgaacctgtattgacaatgacatcaaccgaaaatcgatctgccaaaacagccacggacatagctgacataaccttaccgatacctgactgaacaagaacgacttcatgttgaccgattcgtccctgatagtaagttcgacccaagacatcgatttcagttgcatcttgtagatgctcgaccaaaatctttaattcctgaggcatggctgcgataattccaaatttcatctcttctcctaaataaataatactgcaatgataaacattatcagtaagatgatgacccaaaaaaggattttgtttaccttactgcggaaagcttctcgcttgatggtttcgatacggcgactttttactacagtaggtttgaccgggattcggatcgtttgtccctcttcatatccctgataatcttcttctagatatggatcgaatagagcatcatccattgatatatcctggtttggacgatagtgtccaaactggctagattggtcggaatactgtttctttttcactttctctaaaatttcatccgtcaacaagggcttgcccattgctagtttcctactttctcatgagttgtaaatattggatagccatgatggtctttgcatcacaaatatcgccagtagccaccaagttcaaagcctcttccaaggttacctcatgtaattcgataacctcatcttcatccattggacgaggattttcaaccttgataaggttatctgctaaataaaggcgaattcgttcattacagaaaccgatggctgaatagaaatctgccaacaaggtcaatttgtcactagtatagcctgtttcttcttctaattcacgcaaagcagcatcttcaagcgtatcttcttcgcccagctccaatttccccgccggaatttcataaatagtacgttcaatggccttgcggtattgtttgaccaaaatcattttaccttctggggtaacggctaaaacgcaaactgctcccttgtggaaaatgagttcgcgcttaccagttccaccatttggcaaggcaacatcatctactactacatcaaaaatgtgccctttaaaaatttctgtccgctcaatggttttttcttcaaaattcatatgattacctatttttgacttggatggaacggaaaacgagtcgcataaccttctttgttttcttgacgaccacgaccaataccgatggcatcctctggaatgtcttttgtaatgacagaacctgcagccaacaaggcgttgtccccaatagttactggtgcgatgatggttgaattagagccaacaaaggcattatctccaacggttgttttaaatttatttttaccgtcgtagttgacagtaatggtaccagcaccaacgttaacattattgccaatcgttgcatttcctaggtaggtcaaatgaccagacttcgttccttgaccaagtgtagaggccttgatttccacaaagtttccaacgtgaacatcttttttcaagagactacctggacgaatatgggcgtatggtcctaccgtcacaccttcttcaataacagattcttcaatgtctgagttgctgatgactgcatctgctgcaattttggcatcacgtacacgagtaccattggttaaaacagtacgttcaccaatcaccgtttgccctttcaagacaacattagcttcgataacagcttctgcaccaatctcaacatcaatatcaatataggttgcatctgggttgataaatgtcacaccattgaccatgtgtttttcattgattcgtttgcgcataacagcttctgcagtcgcaagagcgacgcgatcattgacacccaaactttcatcaaaatcacgcaatacataggcaccaaccttctcgcctgcctgacggaaaatcgaaataacatctgtcagatagtactcaccttgggcattgtccgtattaatatctttaagcgcttcaaaaagacgtttattatcaaacaagtaggttcctgtattgatttctttcacttgtttttcaaaatcgttggcatctttttgctcaacaattttttgcacttcaccatcagcattgcgaataatccgaccatatccgaatgggttatcagcctgagctgtcaagatagtcgcaacattcttgtggctgacatggaagttaataaggttcttcaagctttctcctgtaatcagcggtgtatcccctgcgataacaagggtctgaccttccaaacctgcaagagctggctcagccatcataacggcgtggcctgtccccaactgttcagattgaagggcaaactctgactgaccttcgagaactgcttggaccaattctgccttgtgaccgacaatcgttactgttttagcaggttccatagcatctacagcccgtttgacatgctccaacatggtaattcctgccactttgtgtaagacctttggcaagtcagacttcatgcgagttcccttacccgccgctaggataattgcatagttattgctcatagttttctctcttttcaatgatataccctattatagcaaattttgatgtttttggaaaatagcaatattatagggaattttcgtaaataaaaaagaaactggaatgaagccagtttctcaaaaatttctagtattagaaaacaaactacaggttgattgcatcctatagaattgtctatttaggataaaccaattcaaattcttcacagacgaccagcatatcttctgagaaggacaggcctgcttctgccagccagatagtgaaaagctcttcatggatctgtcgccagtggatcagacttttcgcttttatgtcagacaagtcacctccctgacggaactcgccctccttgtaggcatgctctgctgtcacttgggaaaagggcgtcacatagaccttggtggtctggataatgcaaacagcctgaccttgtccgtccagaatgatgtcatagccaccagctcttgggatttcttctccctctacttcatagagagcatgggcagagctggttgaagttttgatgcctctagccaccaaatcagccagtcgatcagcttccgccccaaaggcccaagcctccggctcaggacctgcttgggaattgatggcaatgaattcttgccagagttgtgtcggggtcatagggggtcctttctagaaatttgccaattcttcgcttgatcaagtaaagcctcaaatccataagggatttgatttagaagtgtttcggttatcccaaactgaagtatctcaactaaagcaattaattgaacatctgcaatgtcatgaatatctccacaaagaaattgccacatcccatcttccaagtcatgactgatgtaggttatcggtttattctcttcactatgtgtttacagatcactactgctacatgaggattatcatcaaaaatcaacatcactttcctccctacttcaaactccagccaccgtcaatggtgataatctggccttgcatggaagcgagttttccagtagccagcatgaaggtcagctctgcgatttcgcttggttgggtccagcgtccgataggggtctggtctgccacccagtccgccagaccaccaggctcaaagtccttctgggtcatgcctgtctggacggcaccaggagcgatgccgaagatctggaccttgtccttggcatagtccagtgccaactgcttggtaaaacctgccaaagcgtgcttggaagcggtataggcagagccacctccacctgctagactggaggcaatggagcacatattgataatgatgccagactgtctgtccaccatttgctgcagataggggcgagttagtctagtcaccgcaaaaaaattcaccgcgaagatctgagctaattcgtcctccgaaatatcgaggtggggtcggtaatcgtctaaaatgcctgcggtgttacagaggacatcgactgactggcaccaggaaaagacgggcgataaatcgcctgtcaggtccagctgtagaaagtggaaatcgcctgccaaatcaggcttgctagccagatcaatcccgaagacacgccagccattttccaaaaaaatccctgcctgtgctagaccaatgccgctggaaacgccggtgatgagggctgtcttagtcatggacttctacccagtcggtcgcaaggacatcgcaaggggtcgggctccacatggagaagccttcaccctcgccggtcacgttgatgaggaaatagggcgtcgcctctagcttctgcccgtggacctcgatggtgtcaaagagctggacgtagttctccgccccaccccagcctgtgcgaacgtactttttcttggccttcaagcctggtaaaatctcttcaaatgtcatgattattccttttcttatttattttaacacaaatgttttcagtaacgaataagagttagctaagtactctcttttgttgattgataaatctgtagatagaataaaatcatggcagcacatagaagaccaatcggtagccaaactgtccataaatcaccactaaccagattcatcaccaataattttttgataatgcctatcagtaaaaaagcaaaaatcggtaaagcaaaggttctgaatactttcaccttaacagagaaaactatcgtggccaaacttgtcacaatcacaaataaccaatcgaacatttctggaaatttcaaatagattgccttatctccaatcattgctggtaaattgaaaataatgttaaaaagaataattattgttaggacaatcaagcctataatcattttagaagcctttggcttaaaaagaacagatggtaacagaccgaaaaccagccaacaaagcaacaaagcattggtgcaagaagccaaaaacaggatgaattctaattgaaattgtcccgtgtttgcaaacaaaaggaaggtgccaatggcgtacaaggttgcgaccgcactgaaataggttatcgtcatttccctcaagggagccttcggtgcattttttaaaagttgatctgccatatctttggggtctgttccaaaaaaatctactgctgttagaccatcaacctcagccattttgaaatcactgaccatactataaatctgttccaaaatcgctttttcatctttaaaaaaggatttcaaaatcatatagtcgcgtatctcatcaaaataagctttattttcaggtaacaaattatctacaattatatttgtcttatctcgcaagacttgtttatcgcgtttcattaaatattcctttctgaatggttcctactttttctacaagacttgaccattcccgccaaaaatcccttaaataactctctccatcttgggtaatcgtaaaatatttacgatctggcccgtccgatgatggttttatctcgccaatgatataaccattcttttctaatttttgcaagagaggataggcagttcccccgaccatgttttcaaagccctgttttctcaattcctgaaccagctcataaccataaatctccttctgactgataatttgtaagacacagccgtctaggaccccctttagcatttgggtttctttcataagccctcctcatcatctgtaaaaaatccaaacagtaaacctgatcctaacaggatgcctaagatcaaaatagaatccaaggcccagcctgttataatggccgtcacaagcgtgattcctgctagtttccaattttcccgacttttcttctccagtttcatactgcctccctacctagtttgtaataccgactagtttgataaaaataaaagtgattttctttgtcttctatcactagtttgttttacctattagctttgtatctatagtctaacacaaggtggctagtttgtaaaacaaaatagtgaaaaatattcaaaaaaaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttttcctgttcttgtatatatttcttaattgtggcttcatttagtccaaccgtacttacataatatccctctgcccagaaatgacgattaccaaatttgtatttgagattggcgtgtttatcaaacatcattagagcactcttaccttttaaatatcctataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaggtgtgaagacaatgtggtatttacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataattaaaaacttgggttcccccaagtttaggaaataatctgtttgtaagatcgtgttgtgatggcatagaccactaggtagaggaggagatagccaccacagatgcctgcagtcacctgcaacataagccctgcattgaccacaccgatagacaaaagaatggacgagagcatcttgtaggcaaatgcaagatggacaaaggcaagtaggataggtaggaaaaagacggtcagcaattgcttgcgaatggactgtctggtctgatcctcatccagaccaaccttggtcataatgacaaagcgatctctgtcttcatagccttccgaaatctgtttgaagtaaatcaccagcaccaccgccatcaaaaaaatgagtgaaagtaagaggccgatgaagaaaagtgaacctgcaaaactgaagaaactacgcatcgcataggcacggtaggcgagactgatggcgttcgttccattcggtaatatattggactcccaaagctcactttcaaaactaccggataagaagacctcctggctatttacctgttcttcttctgatagactgctttcaaagcccatataatagcgattttcggcttgattttcaaatattgtcaagtcttgaacaacaataactaaatacttactaaaattaaaagtcacatggtctggcagatgtcccaaggtcacattcttgggcaagacttgggcaacttccatctccttttcatcaaaggtgagggtttgaccagcttgatactggactcccttactataaatggccacttggtcagctgccaactccagtttttgactagtcattttttcatatgtagctttatccaaaatatagcctacacctacttgattagaaaaatccatccatgactctttttccgtcaaaaatcttacttgctgatttgccacctcagaaaaataggcttgctgataaggatagactaccttactttcaacaggaatatctgtctcttctaagatagcttccgcccactcctcccacttctccgtttgagcttttgaagtggttggctgcataccaacatcaatcgaatagtcatttggattttgattggcaatataatctttgccaccgatgtaaatattgagtcctccaaccatggtcaccaagaacatgctggagaggatagtaatggtcgcaagacccagtgcatttttccgcatacggaaaatcaagttggatacagaaatgaaattatctggcttataataataggtctgacggttctttagccagtttaagagactgatgacacctgcgtggaagagcaggtaggtcccaaagataaccagaagagtcgctccaaagaaacttggaatagcctgcatcggactggtcaccagctgggcaatggcgtagcctgcccccaataagataagaactaagagggtttgtagccagaggaagcccgttttcttgtcccctcgcttcttaccttgaaccagtttgagtgagtcggtcaagcccagatttccaatattaaaaaggctgaccaaggcaaaaatcccaaagagatagataaatacagtgactagacttttcaactggaaggttgaagccaggaccacaggcatctgcatggctttcagcaagagcgcatagaagagtttatctagagccagtcccaagagcaagccagctagaatagtaccgactgaaaagaccagattttctagaaaagtcatcaagaagagatgttttttctccagaccaagaatgctatagacaccaaactcttttgaccgctgcttcataacaaaactattggcatagaagaccatgatggcaacggccagcataactacaatcataccgaagcccagcacttgaatcactccattggcccccttgacctgacctaaatcaggatgaaaggcaagtgaggcaaaaatataggcaatggctgtggacaaaatggtcatcagggcatagggaaaatagagtctgcggttctttttgagattggtcagagccaatcgaacggttagtccaaacatactactcacctcgattcgccataagtgtcaaggtatctgaaatcaactgatacatttcctgactagttctctcacctcggtagatttgattgtagaggatgccatccttgatgaagagaacccgtttggcacgactagctgctactgtcgagtgggttaccatcagaatcgtttgcccctcttggttgattttttcaaaaatatctagaagagttgccgttgatttagagtcgagggccccagtcggctcatccgctaagagaatttctggctgggtgatgatggcacgcgccaccgcaactcgctgctgctgaccacccgaaatctcgtagggcatcttgtcttgcaaggtcgcaattcccaggctattgagcgtatgaacgagtcgcttgttcatctcatcaatcggatagcgagacaaaaccagaggcaagagcacattatccttgacagaaagagtatccaagagattgaaatcttggaagacaaagcccaatttctcccgacgaaaggctgccgcttccttgctcttgatagattgggtatccaatccgttaagcaagaccttgccctgcgttggcttatcaagggttgccaaaatattgagcaaggtggacttaccagaacctgactcacccataatagcgacatattcacccttttccactgcaaaatgaatatccttcaaagcttcaacctgtcccgccttaaagagagaactgtatatcttttgaacgtgttgaacatctaaaactgacataacttgactccttttctttttctaccctcattctacacggtcccaagacaaactaccatagtcctagctttcatttgcgtgacagttttgtaagattagtaaaaaatcaactccacttctttgataccgattcgcacctctgttccctgacctacttttgattttagctttagggaatagcccagctccgcagcaattttccgtgagagatagagccccagacccgaagattgctgggttctgcggccattgaaacctgagaagccacgctcaaagacccgttccaagtcactctctgcaatcccaattcccgtatcgcgaataaccaaatcatctccgtccaaaacaatcgaaatggtcccttcctgacaatacttgagggcattggataaaatttgctctatcaacaggcccagccagcgtttgtcggtctttactgtcctatccaactgccccaagtccaagctagtattgacctgaatgaaaaagagggaatactttcttactagatttctgaccagttcatccaaattaactgattcgataaccaaatcatcatgaaaggactgtaagcggagatagttcaagaccagacctgtgtattgctcaatcttgaagagttctgtttctagctgatgacggactggactactatctacttccttaaccaagagctgactggctgcaatcggcgttttcatctggtgggcccagagggtgtagtagtcatctaattctgtctgttcctgtcgctgtttttctaggatttgcttgttctggacttctagtcgctccactttttcctgcaacaaacgctcactggctgtcccagtagtcactttctgaccacgccagatttttccaaagcgggaaaattccctgacaaaatcccagaggagggcgaggagccaacaaatactgaggaggaggatggcatagaaaaccaagtttcttttgatgtcaaagaggctactataagccagaatagccacagcaaaaacggcgtaggctatcagaaaaatcaagcgatgaccaagccatgatgtcaaaaatactggtactaatgagccaaaatcatccttattcatgtgtccacaccaggccgtagcctactcctttcttggtcgcaatcacatctggcagatccagttctgccaatttcttacgcaggcgagcgatgttaaccgacagggtattgtcatccacaaaaatatcactgttccagagttctctcatcagctcctcacggctgaccacttccttgccatgttcaaataaaacgcgtaaaatctgaaattcatttcgcgtcagctcttccacaacctgtccataggacacctgcatggtctttaggtctagggaaatctcctcaaaccagagtaaactttgttctccgacaaagtcataggttcttctaagaagcccctgtattttggccaggagaaccgtcatttcaaagggcttggtcacatagtcatccgcccccatattgatcgccataacaatatccattggctggtcatgggaagacagaaacataatgggcacacgggatgtcttgcgaatttcctgacaccagtaatagccattgaaaaacggcagaccaatatccagtaaaatcaaatggggctgaaactcttccatctgttccaaaaccatctgaaaatccttgacctcttgcacctggtaaccccagtttatcaagtttttagcaactagttggctaatcgttttatcatcctcgataagaagaattttctgcataactatctcctttcatatccctactatttattatagcttacattggaacaaatttgagtatttttatacatttacacaagaagtagactataaaaccaggtcatcagtggtgcagatttgtcagaccaatcatatttcgttatactagataaaaaaggaaaggactgctatgccgaatttattaacttatcttgaagaaactcaatacgataatttttatgataaacctatcaataagctagatattctggctctgaccgaactttcctacctcccttttgataatctggtcccctactcttttacagaaaatggtgtacgacttgatcggttggcagcggcctttgaagagacctacaaaaataatttccctcccttttctatggtgaccaaaaaccgcctagccttactaggacttctattcaaatccaaacgcttcaaatctatcaaggcatttggcttcgttgacgattatcagttggaacaggaaaagcagttttcagcaatcagctatcgcattgaccgaaaaacgattgtgacttgcttcagagggacagatgatactattattggttggaaggaagatttccacatgacctatatggatgaaattcctgcccaacgtgcagcgagtggctacttagaaaaacttatgatgcagcaggggggccatttttatctggccggtcattcgaaaggtggaaatttagccctctatgcagcatgccagcaagctacagaccaacaggatagaattctagctatctatccctttgattcacctggcttacacaaaaaacacttggaagcacctagttaccaagctattcaccaacggattttccctgtcattccccagaattcaatcgtcggtatgatgttagaaacaccagaaaatgctcagattgtccagagtaataccctcggcattctacaacacatcagtttttcttgggaggttgacggaagcgacttcaaaatagcccctgccctgaccagcgatagcctacaaacagaccaagccttaaaaacttggacggatagtttaacagacgatgaattacgagacttcttcgatttgtttttcggcatcttcatcaaagcaggaattgaacgatttagcgacatcacggtaaatcccctacagaaattacaggaaattgatcgactgagaaaagaaatagctccagaagaagccgaaatggtagacaaactcattcggctcctctttgacacccgctaccaaatttggagggacaatattagcacttccattccaagccctgaaatctctctaccagattggcggaaacttttccaaagaaatacaactgaaaataaagaaaactagctcaaccacttgagctagttttctttatcaaatcttcttaaaaattgagataatttttctaatcctttgattagagtttcttgttcacaggcaaaacctagacggacatagccgtcacgatcaaaacgattgccaggaactagaagaacaccgtattcctgcagaagttgcaagcaaaaatcttccataggcatatccactgcaatcttgacaaagctagtggaaacaaccgctggacggatataggaaacgaggggttcttcctcaatccattggtccaaaattgctaaattttcttctaaaatgcgccgatttcgttctagaatttcttgataatgggccaaagctaattgagccaccagatcgtcaaagacacctgcacaaatcatagtgtaatcccgataatctctcagaatgtccgtcacttgatgattggcggccacccaacccacgcgaatacctggcagagaataggtcttggataagctatttacagcaattcctttatcatagacttctataatagatggcacatccagctcagaaaaggaacgatagacttcatctgataggatgtaagccccaacttcactagcaatttccgccaattcttccaaataagccctatccatgacagcgccggttggattattggcattgttgatgcaaatcatcttagtgttaggacgaatgagctgacgcagtttttccaagtctggcaaccatccatgctcttcctcaatctgccacaaatccacttctgctcccaaagactttggaatatcgtagagttgttggtaggtcggataaagggaaatgacatggtctcctggctcaatcaaaccataaagaactaacaagtttgcccctgttgccccgttggtctggagaatttgttctggcttgacgcctgtatagagttgactaaccgattttttaaatgctggcgaaccttctatccagccatagttgagcttggtgccctgtaatttcttataaaaatcctcaggattggtgcccgacaaggcaaatagttcctccaaagtcaatgaagaaatagacactcctgcaatatcataaatcgcgctgttttcatggacattcagccattcctcaacgccaaaacgtggtaatttcataagacttcctacttttatttattctacccttattgtaccatattctttcaataattgtataaatatgcaacataacaagtaaagaatattactattattaaaaaacagactttctcaaacgagactgcctgctctgcttttttcccttaaaacttccctaaattcgtcaagtcttttttgtctggcatgacttccttgttgtcccagtgctcgacaatctttccgtctttgaggcggtagatgtcaaagtgagcgtagtcctgacctgcaatccagactttcgaataagccaccacatagtcaccctgtcccatcaccttaaagacaaagtcgtagttgacttgactctctaccagatagtccttataggctacaccgccttgggcgatttcttggttgtgctgaataagatcagctgccacatagtcgtcaaatttctcgattttcccattttgaaggacatcgaccaagaaacgacggacgattttcttgttgtcctcagtcttatctaggtcagtcagctcaaagtctgcgtaaatcgggtctgtttggccaatggtttttggataggcatcgataacatcccaatgctcaacgatacaaccattttcatccgaacggaaaatgtctgccgtcacccactcagccgcaccgtcattgagtttctggtggacatggacaaagacaaaattcccgtcctcaatggcacggacgatattgatttcccgcttgggattgcgtttgaaaaagtcctcaaagaaagccgcaaagccctctttctcatcaggcacacccgtactgtgctgggtatagctggctcccatatagttttcatgaacttccttgatttcgccatcgcgaatgccacgaaggtaaagatttttagcattttctagttgatttgacatgattttctcttattttaacaatccttcttgttctaaatattccctcgccacttgctctgccgacttgccttccacatcgaccgcatagttcatctgggtcatttcctcggtcgagatgttgcctgccaagacccctaggacttgctccaactcaggatattgttctaaggtttctttggacaatagcggagcggcctggtaaggtgggaagagctgtttgtcgtcttccaggattttgagcttgtaggtgaccaccttgctgtctgtagaatatgcttcgataatctgcacattaccactcttaatagcttcataacgaagggctggctccatggtcttgacattgagttggagattgtagagattttttagaccgatattaccatcttcgcggtcgttaaactctaaagagaagccagcgacagctgtctgctgcacttttgccaaatccgaaatcttctcaagaccgtttttctgagcataatcttccgttacagccaaagcataggtattctggaaagccattggtgctaaatacatcagaccatcctgttccaaaatcgcttctttagcgtaggtataaacctcctcaggattcgttgataaatccattggtgaatttttcaaaagagtacttgtaatggtccctgtgtactcaggataaatatcaatagaacctgatttgagtgcctcataaaggaagctagtctttccgaaattaggttttatctccaccttgatgtctgtctggtcctcaatcagcaacttatacatattgatgagaatttcaggttctgcaccgagcttccctgcaatgaccaactgttttgtggaaaaattaagcatgggaacataactagctccaacagtaaataaagtcaccaatagagccaataaaattgtcttgggtttcttgtcctgcaacagacgaatgccataaccaaaaagcactgcaaggacagccgacgataccgcaccaatcaaaatcagggctgaatcattgcggtcaattccaagtagaataaaggagcccaggcccccagcccccaccaaggccgccagagtcgccgttccgataatcataatggaagccgtccgaatccctgacatcaaaataggcatggcaagagctaacttaaattttttcaacttctcccatttattcataccaaaagcggttgctgcttcttccagagaagggtcgatttctccaagtcctgtcaatgtcccctgcaagataggaaagatagcataaataacaagtgctactactgctggcaaggttccgattcccataaaaggaatgaaaagaccaagcaaagcaagggatggaatagtttggaagatacctgttatttgcagactccactcggtcaagcgttttttactagatagaatcagtcccaaaggtactgcaattgcaatcgcaataatcaaagctagaagggagatgcgaaggtgttcaaaaagagcaattccccactcgtccttgcgttctataaaggtttcaaataggttcattacatacctcctcgagctctgataaattccttgacaaaatcattggcaggacgattcctcaattcatcaggacttcctaattgcacaacttgtccatcttgcatgagacagatgcgatccgccaatttaaccgcctcatccatatcatgggtaacgaaaactgttgtcatcttgaattcctcatgtaattccttaatcaagtcctgcaactgagccttactgattggatccagagctgagaaaggttcgtccatgagtaacactttcggatttgcaatgatggcccgcaaaatcccgatccgctgtttttctcctccagacaagtccttgggcaaacgatccagatagctgtctggttccaagccaaccttggtcaatagctctctcatcctcgtcagggtttcttccttgcccaaacctttcatttcaggaataagagcaatgttttcagctaccgtcatatttggaaaaagggctatctgctgaagaacataacctgtctccaaacgtaattcacgcaggtcgaaatccttaagtcgcttaccttgaaaaaaaacctctccctcggtctgctcaattagacggttaatcaatttcaacgtagttgtctttccgctaccactcggtccaatcaagacaaagaactccccttcttgaatatcaaaggtcaaatttttcaagattggtccactaaccttacaggtcagagatacattttgataatcaatcatcatcttctccttttaaaatagccatgagactctgactgtagcgctgaattaatcctagcataagctcctgttcctcctgactgagttgagacagcgccttattttccgcctcctctaagggatccaaaatgcgactagcaaattgttgcccctcctctgtcaatttaattttcttatgtcgcttatctgctggattctcctctaaaactaccaggcctccatccaaaaatttctttacagtagcattgacaacttgtttgcttgaataggtcttcttactgacccagttttgcgtcacacctccgggattataataaatccacatgagaatggataaacattttgcattgagtccatgtccacgagcatagtcttcataaagaccgacttgctggtcaaacatacgagcataatccttactccttttctcaacttccatcatccttccccctcctcagtgagcacaactaccttactaaaagcctctggtctactagtgttcaaaacaacaacaattttcacaacgacttcctcctgtaatcatgttagtcaatattttttactattttaccaaaaaaagaaaaatagtcaatcattttgactattttgagacatcaactaccttattatagattcccgtcttcatccattcaaacatattaaatccctgaaattatctgcttttaatttacacaaaacaaatgataatcagataacaaaactagcctagaaaattctaagctagtttcattttatccttcaactgcttctgaggtagtttcgcttgctacttctgaaacagtttctgataccacttcagtttgaacatcttcgatatcaatttcaatatcttcagacacaactacagcatcctcaatatcttcttctgtcaaatccactgtcggagctttagcagtttttgccttgatagcttccaaaatgtcagccgttgataagttttgttccgcaattttttccttgatttgctcaaaggtttccaaggatttttccttaccagacttgaccaaatcttctactgtcaattcaccagtttcaagttgagtttttacttcagtaaatcgttcagtcgcttgtttgcctaaatcttgtgccttagtgacaaaatcagcattgatttcttcatggttttctttatagtcattagcaaagtttacaactttttctttgactgttttaccagttttacttgctagaaaagcagctgcagcagctccgccggctgcccctaacaaaaggctagtccacacgctactagatttttttaccatttttttctcctttcttacctaagagagatgagagagttgacagagctgaaagagctccgccggcttttacagtacttgctccagcagacttggctttgactgtcaaatcacgcgctgaagcattcaaatctgatacagaagttgacaagtcagctaccgctacaaaaagaggatcaagggtcgaaaccttgccatttacatcttcgactaaaacattggttttagccaaaagctcgttggtctgatagagagtcacattgacatcgctggtcaagaccttaagcgtttgctgggcttcatccgttaccgtacccaattttttcaacaacaaaacaatatatactgccaccgccgcgatggacaaggcaataatcaagacagaaatttcaataatcatatcttctcctgtagggttgatagaatggaatagaagactttcttctccgcaacacaaccatgataataccaacgaggattaacaccccagatagccattgtgaaacacgtattcccaagaacatgaggctgtccgtccgcaagccttctatcaaaaggcgaccacaaccataccagactaggtagaaagctgtaatttctccctgtttaaggaattttggccgtctacgtaacacacaaaccaagccaaagcctagcaaattccagagagactcaaacaagaaggttggttgacggtaggcaccatcaatatacatctggtctcggataaaggctggcaggtagttcaaactttctactgccttaccataggcctcttggttaaagaaatttccccaacgacctattgcctgagcaatcatgaccgatggcgctacaatatccaaaaaatccagggtattaataaagcgatactgggtaaagaaataaaggacgattgcacctgtaatcaaaccaccatagatggcaataccaccgttccagatagcgaagatagataaaatgttatccttatattcactccatgaaaaggcgacgtagtaaatccgtgcccctaggatagaaagcggaaatgcgattagaataaaatctaaaatatcatcctgacgaattttctttcgcggaccctcttttgtcgccagataaacacctagaatcagaccaagcaaaatgcagattgcataccaacgaatttctaagggacctaatttaatcgcaataggatccatattaagcctcttctctattgtgttcaattagattagacaagcgttcttcgaagatcttcgttgcatcaaaccccatctgtttggcacggtagttcatggctgctgcttcaattacgacagaaatatttcgaccggtttttacaggaatacgtatttgtggaatagcaattcctgctatttcgatagtatcgccagagtttcccaaacggtcaaataccttacctgtttcaaaattttcaagatagacagctaattgcacttctgatgaatctttcacggcactagcaccgtatagactcatgatgtcgataatgccgacccctcgaatttctaataagtggcgcagaatttccgcaggttcaccccagagagtaacatcatcttttgcatagacatcaacacggtcatcagccaccaatcggtgtcctcgtttaaccaactcaagaccagtctcactcttaccgataccagaatcaccctggataagcacacccataccgtaaatgtccatcaagataccgtgtacactcgtccgctgagccaggcgactatccaagtaagaagacaattctcccgatagacgactggttgctgtcttgcttcggcagatagcaatttgtttttcttttgcagccttgtacatctcctcagggatttccaagccacgtgccactatgacaacaggggtttctggctggaacatctgagaaagaacctgatagcggttatgggcagtcatggccatcaaataagaccactccttcatcccaatcaactggatgcgctctggagcataataatcaaaatagccagtcatttccaatcctggtcgggtaatatctgccgtcgtaatttgcttttgcaggagctcttccgtactgtaaacacattcaatccgcagattatcgaccaaatctttcacataaacggtcatttcttccctcactttcagttttattatattataccataagctaggggttgggggaaaaacaagtggctgatttggcaaaaagaatgagttctttctttttctcacaaaattagcaaaacttccacagattaaatgtacttctcttccttcgctacatatttttaacaaatctgttatactttatatagatcaatacttactactaaggagaaaatcatggaacccttgtttctcacacctgttatgcacgaaaaaatttgggggggcaatcgcttaaggaccaactaccactacgacattcctagtgataagactggggaatgttgggcaatctctgcccatccaaatggcgtaactactgtctcaaacggtcaatataaaggaagaggactggatgacctctataagaatgaaaaacatttatttggcaatccaacagatgatgtctttccattattaacaaaaatccttgatgcagacgattggcttagcgtccaagttcatcccgatgatagctatggcttggctcacgaaggggaactgggcaagacagaatgttggtacattttggaagccgaggaaggcgctgaaatcatttatggtcacaatgcccaatccaaagaagaactccgtcagcaaatcgaagccggagattgggacaagctgttgacccatgtacccgtcaaaaagggtgatttcttctttgtaccaagcggcaccatgcacgccatcggtaagggaatcctgattttagaaacccaacaatctagtgatacaacctaccgtgtctatgactttgaccgccgtgacgatgcaggcaacctccgtgaactacacattgagaaatcgattgacgtgctgaccatcggacctgttgctaactcaacacctgcccacctcaaagcaggcaatcttgactcgacacttctggttgccaatcccttctttaccgtatataaatggaatatccaacaagaaatcaaaatgaaacagacagttccttacctgcttgtcagtgtcattgaaggggaaggtgccatccaagtcggtgaaaccagctacccacttcaaaaaggaagccactttatcttaccagccaatgtgacagactggacatttacaggccaaatggacatcatcgccagtcacgcgaactaagcatacaaaaaacttgagcctttaaactcaagtttttttgcattattcaaaccaagacttatttatcttttccgcttcttttatcttacgtggacctgttccatagcgttccgcgtccctatcttccttataaggtaaaaaataagctgctgcaatatagagagcaattagaaggaggaaggatttgcctaagaggagacctgcaatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactataaatatcgcgcgtgttacccaggattcccagaccaatttatgcgctatgccggcaagaaccccagatactatcttcccctgccttactttatataattcaattgacatcttttattcctttcacgtaaaagcccccttgacctgtttgtaccttcaagaaaagtaaatcattgccagatttttcaaactgatagggactatttttctttttccggttaaccaagacatgacctgattgcgactcaatctgcccccgaattccctggcctttgccagtttgtaaagtcaagggagcctgagctagttgcacatacaagtgttggggataaccaccgcaagtcgtcaagcgaatatcctgttgttttttatcccttgaactgcggatagaaatatcttcaaatggtaagtaatccaagcgagcatctgcctgaccaagttccaaatccagcaccgacatccattcctgaggcaagttgattgtcaaacgacaggccaagctactgtgaaaataaagcccctttttttcaacataaagacgaggaagcttatcttctggtgcatcttgattgtagcaaatctccacactaatctgattatttttagacttagccaaagttagacgtccctcagataattttaaaaagagtgattcaatcccttcaaaactataggattgtttcaatttggaggaagcaaagaccttaaaacttggcaaggtaaaattcaattttactttttcttccacaaaaagaaagtctggttcttgattcatttccttaaaacaggcacgcgcctcttccttggtcaagacacctttttcatataactcaattaagcgttcttctctcttttgcgtcatagactcacctcaattctactctagtatatcacatttctccacaaaaaaatcagcccgaagactgattctctattctttcaaagtaagtttaccccgacacttcccacatcggtatttttttaggtcaatgcggcgcttgcgctggtagacttgtccacaggactgacagcagtaaatcagactaggcttagtagcttgttccagttggggagcatagcgcaggccatccaccgcagctagcaattctttaaaatccctgtctccatgccgatagcctttcttctcaaagtagagatggtagtggcagagctcgtggcggacaatcttccgaaagacttctaaaccttgctcctccaaatgcttgggattgaaatccaaatgcccatcccttggaaaaaagcgaccacctgttgagcgtaatcgcctgttccagattgctacatgccgaaattccttaccgaagtcttgcaaggagacttcttgcacatacttattcagatccatttggtttcaaaaggctaagaccgatacgatttcgtttgatgtccacttcaaccacccagacggttacgatttccccaactgcgagaacttcgcttggatgtggcaaggcttgttggcgtccatttttatctcgtttgcgtttgaccatgcgtgaaatgtggaccagaccatcctcgtggacaccgatgtccacaaaggctccaaagtccacaatattgcggaccgtaccttgcaattcctgtccgactaccaggtccttgacatccaagacatcttgacgaaggactggtgcttcaaagtcatcccgtaaatcacgaccaggtttgagcaagtctgcgatgatgtccttcaatgtttcttgaccgacaccgattttttctgccgtatctgcgatggcaagctgcttcaatttttcctgcgcagcctcatctaagtggtcaatagctagaagttctaacagattttccacagccttgtaagactcagggtgcacgccagtattgtccaaaaagttagtcgcatcaggaatccgcaagaaaccagctgcctgctcaaaggccttgtcacccaaacgtggaacctttttgagttgctgacgagaggtcagagcaccgttttcctcgcggtacttgacgatgttctccgaaatggtcttgttaagaccagcaacgtgagccaaaagggcaggactggccgtattgacattgacaccgacctggttgaccaccgtatcgaccacaaaatccagactttcagacagagacttctggttgacatcgtgctggtactggccgacaccgatagacttgggatcaattttgaccagctcagccagagggtcttgcagacggcgggcgatggaaatggcagagcgtttttccacagggaggtctggaaactcatatcgcgccagttcagaagctgagtagacagaagctactattatagcatgaaagcggtacaaatggctcaatagaaaaagcacgtagataaactacatgctctcaatagctaattaaaattcagcctgatccgggtcaagtcgaccttttactccttctagtttatccaactttgcaactgctgtcggactaatagccaagccatcaatttccaaattcgccttaatattttctggactagttgatttcgggagagggagaaaacctttatctaaagaccaagctagtgccagctgggcaacactacaaccagcttctttagccaaatcggctgcttcttggctttggaaaaggcttcctgtaccaaatgggctataggcctccaagagaatccctttggctttgcagtaggccactaattctgactgaggagttcctggggccagcataatctgattagccatcgggataatctcagccgtttccagcaaagcttctagatggtgttccataaagttagaaactccaattactttcacttttccagcacgatagagctcttctaatgccttccaaacctgggcattgcgttccttccagccaatgctgtcgcgaacagccttgggatttggccaatggatcagtaacaaatccagataatccacctgaagtttttgcatggattcttctactgaagcaagggtatcttcatagccaatcttgtcattccaaaccttagttgttaaaaaaatgtcctcacgagctagaccactatcagctatagctcgaccaacactagcttcgttgccataaatctgtgccgtgtcaatgtgacgataaccagcttccaatgcataagaaaccgcaccgtacgtcacttcaccatcgggtatctgccaagttccaaaaccaattttaggaacagttacaccatttgaaaacgtatatcttgtcataaaagacctcctatttcttctatccccagtataaactaaattgtcaatcaatacaaaataatgcgacctaaaaataaaagacacccgaaagtgtctgctcacatttattgtatacttacttttcaaaatttattttcttggatagtttgtcgataacaacagctccaactaatagagaaagcaattctcctgctgctgttgtcaaccaagttagaaagaatggtagatcatataagacttttaattctaaagcaatggtaaacatagttgccgcaaaaaagaatgagaaataaaagaaagccttgttaaataatccaccgaatagatagtccttcttgtatttttcaaacaggataactcccaatgtaacgaagattaatgtcgagaatccacccacaaagaggtcaatcacaccaaaaccaatcaagttagaaatcatgcagccaatggtcacggcgataatatacttacgattataaaaagccaagaaattgagcatttcagacaaacgaaactgaacagccccgaaggaaatagcattcaatggcggtgtcaaggtaagagcgacataaatcgccgcaacaagagcaatttctgccatatctctggcagtccatttagatgtattcataaaattctcctttagcgaaaaagcttaaaatatgcttgggtaaagtgagcaagccccaagggtcattgaatttatcaacaacgttgattagtatagcatatttttgctaaaaatgatagactagtcctatgaaaaaactattttatcaactcatcaataacgaagttattctctatttgattgcaggtgtggcagcaacccttgtctatatggtcactcgaatggggctatttttagtcattccttccattctattggttactcttttagccaatgcagtagctatcctctttgccttttggaccaacgaccgtttcgttttcaaacaagccagagagggttggcctcagcgattggtcaagtttgtatctgcccgcatcgcgaccttggtcatggatatggctctagcctatttattagtacaagcctacccacaattgattgggcagtttgtcaaccatgatttgacacttgtcaacgccatttccactctcttctctcaagtcttggtcattgtggtcaactatttcttgagcaaactctttatctttaaaaatacgaaatgaggctccaacggaacctcatttttatatatagcttgattttcctacttcattctttatctatcgctgtaaatcttgcctttagcctattcaagatagaaacaatatccccatctctggcatgaaactcttctacctgcatactttgaaccgtagcattaatcattgcaccaatgatgagtacctgagccataaaaatgaaccaaagcataaaaacaagaaagacgacagctgttactattctaaaatccagcaacttattagcataattatcaacataaatcgaaaataactttccaatagaagtcatcgtcaacagaacaaataacgttcctggaaaaacatatcgaactttttttatccgaacatttggcaaaaagaaataaagcataaccaaggcggtaaacagagccattaaacctactaactgtgtttgactaagaagccccttcagccaggcgtcttcaataggaaccagcttattaatataagaaaaaactgcctgcccgaaagtcaaaagcgtaatacttaagaggataattacctgcagaccaattcctaaaaatatgccaatcaagtgcccaataataaaatcacggtgttcattgataccataagccttattaaaggccttctgcaaaatagtcatactacgtgacagggtccaaagagttgtcagaattgaaatccctaaccacgatgacgacggctttgttaatacagaagtgataaaagatgaaaccgaaggatagagcttgtctggcacaaattcagctacaaccgataaaatcatatccacatcaaatggataatatggcagtaaattcgcgagagttagaagaatagggaaaatagaaattaacaaatagtaagctactgcaacgcttgttacatcgctatcagcagaacgataaaaagaaaagaaggttgagcagaatgttttcaaaccttcaactattttggttttcttcattctctcctccttcctcattcatctattattcacgaccacaccgagaattaataggtcccttcttcaccttgactggtcaaaataaccggtccatctttggtgatgacaaattggtgttcgtattgacaagacaaaccaccatcaagtgtcttatgagcccaaccagtcttcatatccgtatcaatttcccaagtacctgtattaatcataggctcgatagtcaaaaccataccttcacgcaagcgaagaccacgacctttagttccataatgaggaaccatcggctcttcgtggaaggttggtccaacgccgtgccctaccaagtcacgaacaacaccgtagccaagaccttccgcatattcttgaatggcagcaccgatatcgccgatacgattgccaacaactgcttgctcgataccacgatacaaacattccttagtcacgtccatcaagttttgaacttcctcagagacctgaccaaccgcataagcccagcaggaatccgcacaaccaccacgataggtctgggtgattttcttcatagccttgacatcattaaagttgagcttagaaacatcaactaccgctttatccaaaggctcgctcaaaaccatatcgaccttcagtaaatcaccttctttaagtttgtaatgacgcggaaaagcatgagcgacctcgtcattcaatccacaacaagtcgcataaggataatccatcaattctccatcaacaccaatttggagtggcaaaacattcttttccttacacgttttacggacatattcctctacttcccacatgtccacacctggcttgataatctctcgcaaaccaatatgaataccagccagaacatctccagcacggttcattgcatcaatttctcgttgtgatttaatggtaatcattgattctcctcatacatttctaaactaaattcagccctcttcaagctaaattttagataatttcttgttttatggctatagcggtcacttccgcgatactgcgcaacctgtaccaaaccagcttttttcgccaccatctgactggccacattttcctcatgggtgacaataaccagctccctcagaccaaactcataaaaagctagatagactaaagtcctcactacttccgtcattaagcctcttctccagtagtctttttttaggaaatagctgagctccgcagaaagttgacgttcatctaccttttcaaagcaaagcgcaccaatcatcctctccgaatacttatcaactaaggcccagtttcccaatggtgaacgcataaatttttcaaccattgtcgaaaaagcaatatttctgtcctccaaagctggaaagataaaaggaagattttcgggatttgatacaatttcatagaaactttctccatcttcaaaagaaaatggtcgtaaatacaaacggtccgtttcaaagcaagcaaacttcgctagtcttgtccaaagtgtcatagtgtacccaaggggctgagaattactcccagccccagattgtttcgttttttaaatcgattacgttttgagaaagtagttctcaattagactctctaatcctcaatcaattgaatatctgcacccaattctgtcagtttatcaataatatttgagtaaccacgtagaataaactcaatgtttgtaatttctgtacgcccttgagccattaaaccagcgataaccattgcggctcccgcacgcaaatcagtagctttaacagatgtaccagtcagttgatttggaccttcaaaggcaatatggttgttacgagtagagatttttgctccaagatttgcaagctcctgcacatgaccaacacgtttttcataaatcgtatcaacaatcgtaccagtcccttctgccttaagcagtaaaggagtaatgggttgctgcaagtctgtcgcaaaacctggataaggtgaagttttcacacttaccgccttcaatttctcttgcttttcaacaaaaatactatcttcagaaatggtcatgcgaacacccatttcttccaacttagcgatgtaactctctaagtgttcataaaggacattatcgatacgaataccttcaccaacagcagcagcaagggcaatataagtccctgcttcaatacggtctggaatcacctgatgacgtgttccttttagactatctacgccttcaatggtgataatatctgtacccgcaccacggatacgtgcccccatattattaagcaaagttgccacatcaataatttcaggttcacgcgccgcattttcaataactgtacggccttctgctttgacagctgctaagatagtattaattgtcgcaccgacgctgacaacatccatgaagatatgtgccccttgaatacgctgaccattagttgccaagcgcatatagtcaccttcataggttgtctcagctcccattgccgcgaatgctttcaagtgcaaatcaatcggacgcggtcccaaatcacaaccacctggcaagccaacaacagcttgaccaaagcgaccaaggagggaaccgtaaaaatagtaggatgcacgcaagctattaattttgccaaatggcataggcatgtcttttacaccacgagggtcaatctccaaggtttcaccatcacgcttgaccgtcgcgcccattgtttccataatatcaactaagctatctacatccgagattgcaggtactccgtccagagtaacaatcccgtctgcaagaataatggccggaataagagcaacaactgagttttttgcaccactaacggtaaccgaccctttcagtgtttttccaccattaattacaatttttctcatactaacattcactttcttaatttgcctaaaaaggcatacgtttcattctatcataaagtcttggaaaaagctagttatatagcatgcaaaaggaccgagccaatgagctcagtccttcatatttatatacgattagtgaatctctcttcatcatttatgaaaaattctctgaatttgctcccttgcatccacgagatacaactccagctcttctctcgttaaataaggtactcgcccatagaagatatggtcaatgacttgagcaccgttgctattgaagagccattctgaggtcagggttttcatcgcttgatcaatcggtgtcagacttccatctgcattttgtggctgccctgttggcataaagaaaatagctttcttagtggaaaataatttacgtggttcatcagattcaaaactgtaagcaaagccatgttgaaatacacggtctacgtaacctttcataatagcaggcattccattccaccaactcggaaatatatagactagtaagtcgctttcggcaatcaaatccatttcaacttgaacatctgctggaaaaacagttgcctgacgtacaaatttaccatcctcaatatgaatggtatcttctccacgtaacacgggatcgaatcctatttcgtataaatctcggatgacaacttctgctccattttctagcagagcttccgccactctatcaaccaaagcatgtgtaaagctttcttttctagggtgtgcaaagacagacaattaacgctttcataaacttctcactaagtggacaactatttcattacaaaaccgcagttttcaaggcttccaccttgtccaatttctcccatgggagatcaatatcggtacgtcccatgtgtccataggctgcagtttgcttgtaaatcgggcgcttaagatccaacatctggataataccagctgggcgcaaatcgaaaatatgacgaacagctgcttctagcttgctttccgctactgtgctcgtaccaaaggtatcgatgcgaactgaaactgggtgagcaacaccgatagcgtaagccaattgaacttccgcctttttagccaaaccagctgcgacgatattttttgcgatgtagcgtgccgcataagatgcagaacggtccactttggtcgcatccttaccagagaaggcaccgccgccatgacgagaataaccaccataggtatcaacgataatcttacggcctgtcaaaccagagtccccttgaggtccgccaatgacaaagcgaccagttgggttgataaagtagttggtttggtcatccagataatgagctggaatgatttccttaatcacacgttcaatgacatcctgacgaatttgctcctggctaacttctggatcatgctgggtcgaaataacgactgtatccacacgaacaggttgattatcttcatcgtattcaactgttacctgtgacttagcatctggacggagataagcaatttcaccagattttctcaactcggccaaacgacgcaccaatttgtgactaagtgaaattggcaacggcataagttcaggcgtttcatctactgcaaaaccaaacatgagcccctggtcacctgcaccaatcaaatccaatggatcttgactagcatcttgacgagtttccaaggcttcattgacgccttgggcaatatctggcgattgctctacaagtgacggatgaaccccaaccgactcagctgaaaaaccatactcaccttttgtatagccaatctccgcaatcgtatcccgtaccacacggttaatatccacataggcagtggttgaaatctctccaaacacatgaacactacctgtataaacagccgtctctgccgctacgtgcgcatctggatcctctgctaaaatagcgtccaaaatggcatctgaaatctggtctgcaatcttatccggatgaccctccgaaacagattcagacgtaaacaacttacgttctgacataaaaatgtcccccttaaaatagaatatatgctagaaacctagcgggttactaaggttacaaagaactagtcaaagactagttctttgcgaaagacaactgtcttaagcaaagggaaatttccagatacccaacgagaaagacaataccagactatatgagagtagcctagctttgaagaaaatagtgactgaagtgtagtaaagtttttacgcttactattcaatattaccagtttctttaattgtgtttcaagtgtttctgcaaatattaactagtctataaactaccttttcgggacttaataacgtttctagtatagcatagattgaccgactatcctagcattttcttaaaaataaagagggttgttctatgcaaccactcttctacaaaatcattagataaattcggcatctgcaaatgcctgtttaaccacctctagaggcaaatgaaccaactcacagcccttttctttatacaagtactgagcatagtcatccatgcggtattcattgatatagacaacccgcttacaaccaacctgtaacaattgcttagagcagttgagacagggaaaatgagtcacataggcagtaaaaccttttggaattccccgctccgctccttgtaaaatggcattgacttccgcatgcaaggttctagcacaatgaccatcaatcataaggcattcctgatccaaacaatgttcggttcctgaaacagaaccattgtagcctgttgcgataaccttattgtccttaaccaaaaccgcaccgacttttgctctcttacaggtcgcccgattggcaatcaaaagcgcctgagccgcaaaatactcatcccaagctaaacgatttgttgacatgatttctcctttctccactcaatccaccatcccataaatctctgccaagtcctgtgctgtgacaataccaacaagatcctctggcgaatgaagcttcccactcgcctgacgactgactaggacggttgtgcgcttacgcccttcaaaatgattaattacctgataaagatgggctgttattggtagaacaatcacctgaatactatcttcctcacaagctagtacgtcttcaagactagcctccaccaatttttcacgtatagagcccgtttccttgcttgccttggccaaccaatttgtcaatcccttgtcagaaaccaggccttgataaaccttgtcagaaaaaataggaaacttagaaaaatgctcttgctccacaatttctaaagcctttgtcaatttgtccttgccctcaaaaataaccggcttaattttctgggtcttttgcaaatagtcggcaatggtaatcggttcttggtactgggctatcactttttccaaaacagtgatcaattcctgcgaaggttgggctacttccttcaaacctgttcgtttctcatgaaccatgagattacgcaactgacgagccacatagagtttatcccagttcgcctcaacgggattatgtcgcgtcaattcctttgctttggtcaacatagagcctacatctgcatattccccatccgcaacaccgcacaccttacgcaagaccttatccaagtcattgaataactctaaaaaacgggtttcattcatcttaatctaccattgctgatttcaaataggcatctaccatccgctcagtcgcaactacagaatccaaatgcgtccgttcataggaatggctagactcaatgccagcaccaagcagtgcatgcttgacatctgcacctgctcgcatagctgccgaagcatcggaaccatagtaaggataaatatccagcttataaggaattccatctctttcagccaaggctatcaagtgctgacgaagttcataatggtagggacctgatccgtccttgacacagatagaaaccgtgtactcatccgtctgctggtcatctcccattgcccccatatcgactgccaaatattcaaccacctgagcaggaatgctggagttggcaccgtagccaatctcttcattgtttgaaaaatagaaatgtgtcgtataaggcaaggtcgctccctcttccttatagaccttcaatagatggagcaagatagctgcggataccttatcatccaagggacgactcttgataaagccagtttctgtcacgacggtacgaggatcaaaggagataaaatctccgacttcaatacctaaggcctgcgtctcgtccgcattggtcactttttcgtccaaacgaatttccatgttggtctgattgcgctcagcggtactggcatcccgatagacatggacagaggtctggtgcatgagaatagtacctgtgaaagtcttgccatttttagcgcaatgaattaagcagttttctccctcaatagaagggtatccaaatcctcccaccaaatccattttgagtcggccatccggtttcactgcacgaaccatggcccccagtgtgtccaggtgagcagtcaccatacggtgttcctgatcattttcccccggaactgtcaccaaaacaccacctttagcggtcttactagcaacatagccgaaactttcaacctctgccttgatataattcataatatccgtcgtaaaaccagttggcgacggagtgttggtcaatgtaacaatgtaatcaagtgtcttcatgaaaacctccttatttaaaactattatatcacgttttaggtgatttttttgctataatgaaggtatgaaaacctatcagaaaatatatctccttttaaaagagagagaggattatgtcagcggagaagatttggcacaggaattgggcatttcacggacatccatttggaaggccattcgccagttagaaacgcatggtttaactattgaggctgcccgtaatcgtggctacagattagccgaaggcgatttactcctacccgaattaatctctcaggagcttcaactacctgtccatctgaatatggatagcgactccacccagctagatgccaaacaaggtattgaatcaggtcatactagtcctgccctatatctagctccctatcagaataaagccaagggacgatttgggagacccttttatgcctccaagtcaggtggtatttatatgtcgcttcgtctctctcccaatgttccatttctagaatttaagccctacaccattttagctgcagctgctgttgtgaaggccattcaatctctttgcgacttggacgtccaaatcaagtgggtcaatgacatctatctcggacacaaaaaggtcgctggcatcctcactgaggctatctcttccatggaaaaccaacgggtaaccgatgtcattatcggtgtcggcatcaatgtccgcatagacgatttccctaaggaattacaacaatctgcaggaaatcttttcgaggaacaaccaccatttacccgcaaccaactcattactgccatctggaaagccttcttagaaaccgatgagaaggaactaattgccctttacaaagaaaaatcacttgtcgttggccaacaagtgagctttgtagaaaatcaagttgaatttaagggtactgccatcgctgttactgatacaggaaacctggttatccagttagataacggcaaagcaaaaattatctccagcggagaaatcagccttacttcttggtctgcttctccaccaaacgaataaatttagtcaccttgtaagcaaaatgaagattccgataggcgataaaggcgtagatacctgcaatcaagaaatctcctgtcaaaatcgatgcattcataaaataaacagctaaaatagttgtaatggctaaaaaaagaaattgtggaagtttcataaaatagattataccaaaaattcagtcaactggctgaatttttatatgctttcttgataggtttcgattcttttctaaacaagaaaacaccaatctaattggtgctttcttaaggagatatgaaaaatatttaggattgaatatagtataaaatatctatcaaaactattcatcagtcttaggactgatattttctaatcatttctaatctcaactgtatctgcgagaaagccaaattcttctgggactggactggcttctttttcgatttcctgtgtcttttgcccttttgctttcgccgaaaattcagcacgaatacttacccaatcttcctgagcaatagctaaaatctgtggggaaaaaccagctgccttgctgagaatatttccaaacatggtattgagattgtcacgcttcatcgtctgttcagcattaagcggagaatcaaaggctagaatcgcatgattttcattggcagcaactggctgggaaccaaccaacaaggcacgatctgcacctgacagactctcgataatttctccccaagcattctgcaagcgagtcaaattttcacgcgccaaggttggattttccatagcttcctgcaaaatagcatgaaccttgctggtatccaatcggtacttcttcggagcctgcggcttgcgtgaaactggcttaacagcacttggttgactagataattgacttagttgtttctgtaaatccgcaacttgttgttgcagactggctagttgccccagtaaatcagctggcagctctgccattgcctccgaaggagaactatcttcagccaaacgaatggtcatcatttcagcgtaaatcttgggttgaggactggacttgatgtccgccaaacccctggtcaccatctctatcatggtaaaaatccgtgcctgctcaagagctagattttctgaaaaaactgttgttaaatgcgtatcctctccacccgtctgcacgataaggacatctctcaaatagtgcaaaagatctgtcgcaaaacggctcatactctttccttggtcaaacaaggtttgtagatgctggagagctgtgacactatccccttgacgcagacttgccacatagtcatccaaggcacgcaagctgatagaacccgtaatttcctcagcaatttccaaggtcacttgctggtcctgactaaggctgagagcctgatccaaaatagatagggcatcccgcatccctccttctgcccgacgcgcaatgattgtcagagcctgttcgtcaaagattagcccttccttggttaaaattgcagccaagtgctcctgaatgtccgtcaccttgatggacttaaattcaaatcgttgcacccttgacagaatggtagcaggaatcttgtgcaattccgtcgttgctagaataaagaccacattttcagtcggttcttccaaggtcttcaagagggcgttgaaggctccagtagacagcatgtgaacctcgtcgatgatatagaccttataggtcgcaagactaggtgcataggtcgatttatcacgaatatcacgaatctcatccacaccattgttggaagccgcatcaatctcaatcacatcttccaggctaccttccgtaatggcctgacagatataacaatcgttacaaggctcgcctccaacctgattaggacagttcatggccttggcaaaaatcttagctgccgatgtcttacccgtaccacgaggacctgaaaagagataggcatgactgattttcccttgttcaatggcctgtttgagtgtggtcgcaaccacctcctgccccaccatctccccaaaggtctggcttcggtacttcctatataaagcttggtacattagcgtttttctccaaacatagcaaaattccagtccgtcttctcaaccaagagagcaacgaacttttccagatagtcttggtcaatcgtatcataatcagctaccaatctcgaatccaagtccaaaacgcccagcaactggtcgtttttcaccattggcacaacgatttctgatagggctgtcgcatcgcaggaaatatagttatcatgtagacgaacatcgtctacgagaatagtctggcgcttagctgcaacctcaccgcagacaccctttccaagtgcaatatgaacacaggaaacgcccccctgaaaaggccccaaaatcaattcactaccatcatacaagtaaaatcctgtaaagacagagtttggtagagcttgattgagcaaagcagaagcatttgatagattggctaaagcattggtttccccatcaagaagagcttccaattgagccaacaataattgatagtttgaaattttttcttgttttgtcataggaacattatagcatagttaagccgacttttatagtccgagcgataaagaaaaaggcttgcgcctatttccacatccagtacataatcactgcatcaatcaatacccctatagcccaggctagttgaaaatactttttctgtgtcttatgccgaaaatgggttccacctgcccaggcacccagcccgccaccaaaataggacatgagtaataaggtcttttctgaaatccgataggcgttttttcttgccttccctttatccataccataggtaatgaagacaagtaaattccaaactactagcgccatactaaccatctgtttgattgacatacattcctccaattaagtcacatttcttcttactctaacataatccaaaacaggacacaaggaaaaacgattcggaaatccgaatcgttacatttctgccagtgtatcctctaaccatttgagctgggcacggttgcgttcaatagcccgtgtcaaaatcaaatagtgtccataattgtcttggatactttccttggttgagaacagctcaactttacgactgtctaggtgttttaagtgcttggtgactagttcaatttgactctgcaacaaaccaggaatccgtgggtcatccttttcacggataaaaaacatcttgattgaaaacaagtttttttgctgaggcgtttcttcatttggaatggatagccattcgtctaaaatctgacgaccagtagccgtcatcgcatactgcttttccttttcatttccaggtactgcatgacaagtaatcaattcttccttggtcatacgttttaattctggatagacttggctatgggcaacctgccaaaattcgcctaaatcacgttgaacatagtcggtaatctgcttgccagttaccatttgaccgctagcacccataatccctaatatgatatgaggtaatattctttgcttcggcatcttaaccacgctctcttaatatactctccaccttggtgttaatcaagtcgatggctacaacgttgctgacgccttcaggaatgacgatatctgcatagcgcttggttggctcgataaactggtgatacattggtttcaccaccgaggtgtactgctcaatgatactatctaagctacggccacgctcttccatgtctctcttaatgcggcgaatgatacgaatatcgtcatcagtatcaacgaatatcttaatatccattaaatcccgcaaccgtttgtcttccaatactaaaataccttccacaataaatacatcttgtggttcctgacgataggtcttctctgaacgtgtgtgctgagtgtaatcataaatcggaatatccactgaacgtcctgctaatagctcactgatatgataaatcatcaaatccgtatcaaaagccagtggatggtcataattggtcagtatccgttcttcaaaggtcaggtgagactgattcttataataagaatcgtgttcaatcatagatatacgagcatttgggaaattatccagaatggcacgtgacacacttgtcttgccacccccagatccgccggttacgccaataataatgggtttctgagtcatcatcatctccttctattttcaatactattttaccatgaaacatggtataatgaaaaggataacacaaaagaaatgagaatttatgcttaattttggtattgttggcacctcagacatctctcatcgttttatagaggcagcccatttaagtggacattatcagctacaggctgttttctcccgtagactagaaactgctgctgccttttcagagcagtatgaaggagtcgatttatacacagaatgggtaaaatttctttctgctcccattgatgttgtctatattgccagtccaaatgccctgcactttgaacaggcaaaagctgttctagctgctggtaaacatgctattgttgagaaacccatggtttctacacctcaggaattagaacaattgcgtcgcgttgcccaagaaaataatgttttcctctttgaggctgctcgaaactatcacgaacaagctcaagccattatccgtgaatttttgacggataaaacgattttaggtggttcatttgggtatgccaagtattcttctaagatgcctgaattgttagctgggcaaatgccaaatatcttttcaactgatttttccggtggtgctctcatggattttggtgtctatacgctctacgccgctatcggcattttgggaactcccagaacggcccgctatgtagcacaacagctaccttttggtattgacttaaacggttcgggacaactcatttatgacaactatatcgtccacattcaagcatgaaaaaatattacaagcaatctagcgagcgaaatctatacaaatgatggaacactaacactcaacgcatgccagcatatcagctccgctattttcacaaaacatgacggagagcaaattgttttaccaatccaagcggcccagcatcctatgctcgaagaagtgttagaaattgcacaggcaatcaagcaacaaaaccgcaagcttgtggaccagtggctggctgtggcagaaagcgtccatcaaacactttacaccatgcgtcaagacgcaggaataatctttaaggcggataacaatgaaatctaaatttccctccagctggacggaccagcttaccctacttggctttgaggactttactcctatccaagtccaggcctttgagcctattgcaaacggcaagtcccttctagctatcagcccaacaggcacaggaaaaacccttgcctacctctggcctagcctattagccctaactcctaaaaaagcccaacaattgctcatcctcgcacccaatacagagctggctggtcaaatatttgaggtttgtaagacttggtcggagacaattgggttgactgctcaactattcttgtctggttccagtcaaaaacgccagattgagcgactaaaaaaaggaccagaaatcctgattggaacacctggtcgtattttcgagttgattaaattgaaaaaaatcaagatgatgaatatcaacaccatcgtcctagatgagtttgatcagctgttctccgattctcaatatcagtttgtcgaaaagattatcaactatgtgcctcgtgaccaccagttaatctacatgagtgcaacagctaaatttgaccgtcaaaaaattgctgaagacattgaaagcattgatttatctgagcagaaattggataatatccaacattgctatatgatggtagataagcgtgaacgtttggaaactctacgtaagtttgccaatatccctgattttcgtgctcttgcattttttaacagcctatcagaccttggtgcaagcgaagataaactactctataatggtgtgaatgcagtttcattggtttctgatgtcaacgtaaaattccgcaaggtcatcatcgaacgtttcaagaatcacgaactcaatcttctacttgctacagatatggtcgcacgtggtattgatattgataacttagaatgtgtcctcaactttgaagttccttttgaccaagaagcctacactcatcgttctggacgtactggacgcatgggcaaggaaggtcttgtcatcactctagtatctagtcctagcgaactaaaacaattgaaaaagtatgcctccgtccaagaagtcattctcaagaatcaagagctctacaaaatataatgaacaatatacaaaaggcttagaaccagtgtttctactaacatgattctaagccttttatcattcttactgggctgggccggataattcttgtgaataatagattaattgaggattgagaggactagcgagtaagtctgttacagtaaccatattgtagccctcacctgttaaatattgcaatacagactcgaggctatcaactgttgactgatgaatatcatgcattaggataatacttcctggacaagtctgttcttttatttctttcaaaatggcttggggattgcgactcttccaatctttagaattgaccgaccaataaatcgatggaagtcccatctgattgacaacggcctggttaacagaaccataaggaggacggaccattgttggtacaatacctgtagcttcagtaatagctgcctgtgtatcttgaatttctctctgtacttgctccccagaaatagtgactagattgggatgattccacgtatggttggcgatgacgtgcccttctgctaccattctacggagaatagcttcattcccaactacagccttaccaacaacaaagaaagttgctttggcattatattttttcagtaaatctaaaactaccggtgttgtgttcggattgggtccatcatcaaaggttagagcgacctgtctcaaatgtttcttatccacaacttgtgcagccatatactcatcatagccaaccttatcagcatctactagataatcactcttcactactgggtacaaatctgaaattggtagaaccaactggttgatgccgtaaccatctggtaattgtaaggttaattggctgtctccataactaaaggaaatagcatttaagtctagtgtttcaaattttttgacaatcgcttctacatcagtctctttcattccttgagcaagtaaggcttctcttagatgatcaacaataatacttgctgcagaggataaattaggtaataaatcttctagagtaaacaattcattgtcctgcgtcaataacacacgctcagacgggagtttatcctgctttttaatttgcaagttgtctactttatagtgctccgcttgaatttcacgagctgttacatttttaaaatttgtttttccctctattgatgaaacaaagaccagtttttgaatttttcctgctggttttttatgaccaaagcgtctttgaacataggaaatcattcgactttctacaggtcctaagacatgacctgcatcatctgtaggtaaggcagccacaacatgggtcgtatcaatatttccctcttgaattttgcccttgcctttagcgaggatggtttgttgtttttcctcaataaactgactaacctgtctttcttgaagtcctgcaaataaccatacagccaaacttaccattatgccgagcaaggcgatgttgattcccaaccaaaaactaacttttttcatctccaacctcccattcaaaacatatataaactatgctaaatcatttaaaggctcttgtcaagacagttctataaaaactcataaaaagattaggtaatactcttcgaaaatcaaaattatccgttgtcaactttccttgatgaactccagttccatcttcggcttcgtttcctagactacttttgattttcattgagtataaataattgatttgcttcctaattcccccctcctgccattttctgatttttttttgaaaagaaaaagactgcctaggcaatcttttctaaattaatctgcacgaatgacttccacacggtagccatctggatctgtcacaaaataataacgacctggacttcctggcaatcccttgatgtctgtcgttggatagcccagctccttatgtttcgcattgtccccttctaaatcatctgaagaaagagctagatgcgagaaaccgtcgcctacgatatagggaccatgatcataattgtaggtcaattcaatctcaaagtcatctccttcaagtgctaagtaaaccaaggtaaacttgtgctctggatagtccttgcgacgggtttccttaaatccaaatgcttcttcataaaatttttgagatgcttctaagttctcaacacgcaaacaagcgtgcaacatttttttacttgccataataaattcctcctaccatttaataccaccagtataccatactctctatgaaaaatccgatattcaaaatcatgaccacccgtcaaacgggtggtttgaacaagggctataagcccacatcaccagccagcgcctaaagacgctggctttcactttgttcaagcctcactgcttttgactcgtcactagcctcttaaagaggcattcgtactacttgccattatccctaaagggatcttcatactcttttacactcaacttatcaagtgctatatcatgtttaactcgctttttaagctgaagctcgtgaagaaatcatccactggataatttctttattcttgtatatatttcttaattgtggcttcattaagtccaaccgtacttacataatatccctctgcccagaaatgacgattaccaaatttgtatttgagattggcgtgtttatcaaacatcattagagcactcttaccttttaaatatcccataaagcttgatacacttaatcgcggaggaatactgactaacatatgaacatgatccggcatcagatgtccttcgataatttctacgcctttataagtacacaaacgtcggaatatttctcccaaactacttcgatattgattatagatgatttttcgtctatacttaagtgtgaagacaatgtggtagaacacagccactttgtatgtgataaactatgtgccttttgcgccatatttttctcctttcgctttacaataggcttgaacacctttattgtatcgcgtttggagtttttttggtgtaaccttcgtcgcgcacccgcatagcgggtggtttatttgtcacgcaccttacggagcgtgacggactaaaagtcacataactaaaaaagcctgagcgaactcaggccttaaatgaattatgcttccaagtagtactctttcacaatgttcaagttttcatccaattcgaatacaagtggtgggaagtttggaatttccacatccatgatttcgtcatcagacaattgtttgatgtgttttacaagggcacggattgagttaccgtgtgcacccacgaatacgtttttaccgtctttcaatgctggagcaattttatcttcccagaatggaagggcacgctcaagcgttactttcaagttttctgcatctggaataactgaatcatcaaggtgtgcatagcgacggtcagtgtgtgctgaatgctcatgatctttagccatttctggtggcaaagtatcataagaacgacgccagatgtgaacttgctcatcaccaaattcagcagctgcttcagctttgttcaagccagtcaaaccaccgtagtgacgttcgttcaaacgccacgatttttcaactggtacccacaattgatctgcagcttcaagagccaagtttgtagtcttgatagcacgtttcaatacagatgtgaaagcaaggtcaaattcgatacctgcttctttgatcaatttacctgcatcgattgcttgttgtgtacctttttcagacaaatcaacatcagcccaaccagtgaaaaggttagctttgttccattcagactcaccatggcgagcaaaaaccaattttaccatttatgaattctcctttaaattttgaggttcccctcttatacttctctattttacacgaaaaggtaaaaaaatgccagcctttccacaatctgtgtacgctttcattactctttcatgtaaattcagtctctagacctatctttcttcttagaaaaaatacaaaataatggtataatagtaaggctgaacacgacagttcaaaacgataccactataggagttatcatgaaaaaagtagctatcgtgtctgcctatcgttctgccatcggcagtttcggaggtagtctgaaagatattgaaatcgctgatttaggggcgcaagtcctcgaaacagccttagctagtaaaaacatccctgcagacagcgttgatgaagttatcttcggaaatgttctttcagcaggacaaggacaaaatattgcacgtcaaattgctattcgtgcaggcattcctcagacagcctctgcctatgcagtcaataaagtctgtggttccggtctcaaatcagtcctcctggctgcccagtcaatcatgctaggtgacaatgatgtagttgtggctggaggcattgaaattatgagccaggcaccttatctatccaaaactagcaggtttggtagtaaatttggtcatattactctagaagattctatgctgacagacggtctaacagatgccttcaacgactatcacatgggcattactgcagaaaatgttgctgaacactatcaagtcagtcgcgcagagcaagatgcttttacatacagtagccaagagaaggctgcgaaagctattgctgagggaagatttgttgacgaaattgttcctattagattaaaaaatcggaaaggcgaaactatttttgccacagatgagtaccctcgtctgacgccaattgaaaaattggcaacacttcggccatcttttaaaaaggatggaaccgtcaccgcagccaatgcttctggcatcaacgacggctgtgctgtcttgatactcatgtctgatgaaaaagccagtgagctaaatatccagccactcacctatattgaggcctatgcaacaagcggtttagatcccgcattgatggggcttggacctattactgctagccaaaaagcgctacaaaaactgaataaaacagtcgaggatatcgatctattcgaactcaacgaggcatttgcagcccaatcaattccagttgtcaaacaactcggcattgatcctgcaaaagtcaatgtcaatggtggtgctatcgcccttggacatccaatcggagctagtggtagtcgaatcctagtcactctgattcacgaattaatcaagcaagaaaaagagcttggtctttgctcactttgtatcggaggcggtcaaggcatctccctaatcgtttccaatgcgcaaacaagttaacctatcatttgtacacaaaggatatattatgaacatcggtattgataaaatcggatttgcggcacccgattatgttttagatttggctgatttagcccaagcccgcaatgtggacccaaataaatttaagattggtcttcttcagtctgaaatggctgtagctcctgtcactcaagatattatcagtcttggggcaaaggctgccgaagccattctgacagaagaagataaacaaaccattgacatggttattgtcggcacagaatctagcgtagatcaaagtaaggctgccgccgtcaccattcatggattactcggtattcagcccttcgctcgctccatcgagatgaaggaggcttgttacggtgcaacggctggactaagtcttgccaaaagccatatcgctcaattcccagaatcaaaagtcctagtcattgctagtgatattgcaaagtatggagtcgcttctggcggtgaacctacccaaggtgctggggcagttgccatgttggtaaccgcaaacccacgaattttggtcctcaacaatgataatgtctgccagacacgtgacatctacgacttctggcgtcccaactacgacaaatatccacgtgttgatggtaaattttcaactgaacagtacaccgattgcttgacgacaactttcgactactatcaacaaaaaacaggcaaaaccctcaacgattttgctgccatgtgcttacatattcctttctccaagcaagggcttaaaggactgcaagctattgctcaggatgaagaaactcttagtcgcttgacagaacgtttccaggaagctatcgtctataataaagtcgtcggcaacatctacactggctctatcttcctctctcttctttcccttttggaaaatagcagagcgttagagacaggggatcaaatcctcttttatagctatggtagcggcgctgtctgtgaaattttcagcggtcaactcgttgaaggttatcgcaaccacttacaagaaaatcgtttagaacaactcaatcagcgtacaaaactcagcgttaaggaatacgaacaagtcttctttgaagaaattacccttgatgaaaccggttcatcccttgacctaccagaagaccaaagtccctttgcccttatcaaagtggataatcacaaacgtatctatcgtaaataaaagccaaaacggcgccctttggctctcaccaaggggcgctttcctatagaaagaggaacctatgtcaactttttccggattttataaaaaatcacgccaagagcgcattgatattctccgtcagaatcgttccctagccgaagatagcttagacattctatacaaagacgaaaacctgccagaagcaattgcgggaaagatggcagaaaatcatctaggaacgttttccttacctttttctgtacttccagaacttctagtggatggacaaacttactctgtaccgatggttactgaagaaccttctgtggttgcagctgcatctttcggagccaaaatcatcgctaaatctggcggttttacaacgactattcacaaccgtatcatgattggacaagttgctctctacgatatttcggaccatagcagagcgacacaggcgattcttgaccataaggagagtattttagaaaatgccaatcaagcacacccttccattgtcaaacgagggggcggtgcaagagaattgactgttgagagtaaggatgagtttttgattgtctatcttcaggttgatgtacaagaagccatgggagccaatatcctcaataacatgttagaagctgttaaggatgacttagaagagctcagcaagggacaggctttgatgggaatcctctccaactatgcaacggagtcactgatcaccgcccaatgccatattgccatctctagtctggctaccagctctgccattgctcaagaaactgctcaaaaaatagccctggcaagcaaactggcgcaagtggacccttatcgtgctgcgacacataacaaagggatttttaatggtatagatgctgtcgttatcgctgcaggaaatgactggcgggcagtcgaagccggagcccatgcttatgccagccgtgatggacaatacaaggggctttctacttggtctattgatggcgagcacttggtcggctccatcaccctacctcttccgatcgcctccgtcggcggctcgatcgggctcaatccaaaggtagcagtcgcttttgaccttctccaacaaccaaaggcacgccaattagcttctatcatcgcttctgtcggtctctgtcagaactttgctgccctgcgtgctcttgttacttcagggattcaggctggtcacatgaagctccacgcaaaatccctagcgctacttgctggcgccgaggagcatgaagtagaccaactagcccaactcctgcggaaagaaaagcacagcaacctagaaactgctcaaaacttattagcaaaaatgagagaacattgggagtgggaaagacatccatgatggctccgccctcacccacagaataatgaaaacgaacataaagccctcactaggtgtataatcttagtgagggctttgtggttgacgagttactgatgttagtcatcgcgggaaaaactaacccactctactgacgagcaccccaaaatatgcgataggcatgagtataaaaatacgactacaattcggtagataagctctctaatttttagaaggagggaattatcatggaggttctctatcaatcttgtgcaggtattgatgtccatcaagccaatattgtcgtctgtatcctacatggaccactcacctcaactcgtccaaagcgtgagatggctacatttgatacaacgactaaaggcctacgtgcttgccacgattttctcagtcaatttcatgtggaagctgttggtatggaaagcaccggtgtctattggcgacctgtctggcatgctctatgtgatgacttcgagttgatactcgctcaaccagcccacatgaaggctattccaggtcagaaaaccgacaagaaggacgctcactggattgccaaattaacacggattggtctgcttcctcggagtttcgttcccgatgaaaccattcaagaattgagggagttgaccagacaacgaaaacattatgtggaaagtcgcaatcgagaaacaaaccgtatccataaaattcttcagtcaggtggtatcaagctaacaacctatattgaagatattatggggctatctggtcgcaatctccttcagctactggttgatgggacgcctattacacctcgcattgtccatcaatcagtttacaccagcttgaagaagaaagtgccgcagcttctggaagccttggatgactatttttctgaccatcaccgctttatgttaaagcagtccttagagatttatgatttttatcagaagcagattgagttgttggaagagcgaatgaatgtctatctatcacaatatgaaaaacatgtagaaatattggattccatcccaggcattgatgtcattacagcttctgttatcatttctgaggttggagttgacatgagtcagtttccgacatttggacatttagcttcttgggctggactctgtccaggtaataatgagagtgctggtaaaaaacgaagtaccaagattcgacacggaaattcatatttgaagaaatgtttatgccaagcggccttcgctgtcaaaagacaaaaaggcagcccattagcagaacgatattatcagattcaaagtcggcgtggctcacaaaaagcaaccattgcacttgcgcatcaactattaaaaatagcctatatccttttaaaagaacagatgacttatcctgaatttttagcacaaaaaaaaagactactagggacgagctagtagcctaacataaaaaatttttcgctttgattatatcatagggagggagtttttgcattcttttgagttttcgtataagaactcgaccaagataaaaagagttcgtcttcccacccccgcacagttgattaggccagatttggagtgcaaaacacgaacaaatctgccaatcaaccactgcgctgagatgttgacacgaactctgagtagtggtcctgggctttttgcccagcctcactctattatttgctccatacggaacttttgtggtttcattccttggcgttcataaaaacggacagctcctgcattgtcagcccatacatccaaggtaagattgtggcaaccctgctccttagcataggaaagagcaaattcataaagctgctcgccaattctttgaccacgcgcagaattggctacacacaaatcatcaataaacaaggttttaattggttctaaaacatcgcctgttgcggtagataattcacaaaaaagatgcccaaccacttgtccctctaactcaaagacaaaaataggcttatctggattttccaaaagtgctactaattcagcctcagaaaatttttgacctgcacttttaaaaatatctggtcgtgcttggtgatgcacctgtaaaatatcttgaagcaattcatttaatatcggaatgtcagattgtctagctttacggattgtcataatactctccttttgagtttttattattatagcacatgttcattttttaacaaaataggtctacagaccgatgaagaatctgaaaattcgagtatactataggtgtatcctaaaatttttcataaatctcctaaaaaatcagctggccaaggctggttttttgttgtcttaaaacgagaatgtgtagtgtagaaaactactaaagtttctctctctttgacgcaaaatgcttttgcttcatttccaacctcccagagtcactcccctgactctgggagccccaaaacacagaaacatactaagattagtagtgaggaaatctccgacgggagaaagtactcactactttttctttatgataaagtagaggtgtcttgttaagtcgtagggctttttgacgctagacgtcgcaacaaaaactggcaagacacctgttttagaaagaatgttatcaaagtatgtgggacgccagacgtcgagtattgaaaatgacatcgctaaaacaaggaatcattcaagacaaagaggtaatatcatgcgagtagtttttgggattgatgtgagtaaggcaagttcagaagtggccattctagtcaatggtgagaaagttcatggctataccatatccaatgacgccatcggctttgctcggctacttggcgatttgagaaccgtccataagccagaaatcatctttgaagcaacaggtgtctattctcgccgtctccaaacttttctagatgataatggctatgcttatacacggcttaatcccttagaaactaagaagcaactggatagcttgcgtgtgcggaaaacagatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacagggtcttacaggtcactttccctgaattggaaaatatcttatcgacaccatctggcgaacaatactggaacttagttatagcttttccttgtaaggactgcgtacttgagttaagcaatgatgaactctcaaagagcatccgtctgtccacttcaaaacggatttctgacaagcgtgtggcttacttagccgagaagcttatagcactagctaatcaatcttattgtgccgtcaagaaaacctctccaatactggaagaggtccgttactatacaaaagaattgcttagactttctgaacagagacaggcagtcttagacgaaatggtggaactagctcagccattacctgaatatgacattctgctctctattcctggaatagctgagactactgcaacaagtattattggtgaactgggagatattcgccgttttcagtctgccaatcaaatcaatgcctttatcggtattgacctgagacactatgaatctggtaacttcctcgctaaggaacacattaccaagcgtggcaatccctacgctagaaagattctgttcaagtgtatccacaatatcgcttcagccagtcataccaatccttgccatatcgcagacttttatgagaaacgaaaaagacaatcgcaaacgacttcaacgaagccgcacacgattgcctccatacatcgtctcattcggacaatgtattacctcattatgcataacaaactttacgattacgcttcaacccaaaatcggtaaaactgtttatgctctatcattgtaacaccttatcaaaaaatttcaacataaggtgttggttttgtatgcactttttacactaaaatgtagtccaaaataaaacaatttccttattttgactattgaactcaaaatatttttcgtcaaataccttgatggacttgacaaatagtagaaaaaaagcccgtcggacaagctagaaagcttgatatgacgggctttttgatgcttagcctcgctcttttgtttttaagcgagggataaaacagtctatccccagactgttttattttacagcgtctttaagtgctttaccagctttgaaagcaggtactttagatgctgcgattttgatttctgcacctgtttgagggttgcggcctgtacgtgctgaacgctcacgaacttcaaagttaccgaaaccgatcaattgtactttttcaccagctgcaaggtagtctgctactgctccgaatactgcatcaacagctgctgctgagtcttttttagtcaatgaagttgcttctgcaacttttgcaatcaaatcttgtttattagccatttgctaagtcctccaataattttctgagttattactcacttctatatagtaccgaattttaggcgtttggtcaagtttttaatgctattttactgtctttttctgtagatatcaacaatgaattggtcgttgtacaaatcaatcgtattcgcctttccatacagaccaaatttgttcttcagttctgtcagttgaacctgtacttgcgcttgttctgagtctatttttacaaaggcaggtagtttataatttttttgtaaataagctaatacctctgctttcggcaaggataaacttccaactgatatttctgttatccgtaacaaaatactgccatcttccattttgctaggttgaaaataaatatagagtgggatagtcacaccaaaaatctgatagctgccttcaaaaacaacttgctgactcgttacgaataattgataggaaaactcttccgtctgatactcttttagatagttagtgagggtttggttgagctgttccctattagtggagaaggtcccaacctttgtgtcttctgtactagtctgaacgagctttgttaaatcctctctatctgtttgaatccgtgtatagaggactattccgcaaccaatcaataaagacaactgggctaaaaataaccatttccaaatattaaggttcccagctttccgtggtctcattcattctctccaatatcgcttttttcataatctcatatccagtattattgggatggaaactgtcttcctcatacagtaaattattggtaacttggctaccattttgactaataccagcctccccttccaatcctttataaagcaaatcattgatcggaacaaagtagacatgctgatatttttcagttatctgttctgtcatcgtattccaattatcaacaattgtctgcatttctgtcaattcaggaaaattgaggtagagtggattgtaaatcccgacaacatagatgggaagatttggattattcttacgcgctgtcttaataattgtatccaattgttttccgtaatcttttgcgggcttatcaaaagttgaaactttgagattggcaatgtttttaataatagccttgcgcaaatcgttgccaccaactgtcagagttaacagatctgctgtttttaagtaacttatcagctctccatcttccttcattcgtttaagaatctgattactggtattcccagaaactccgaaatttttataatctacttcataaccataatcattagttagagattgagccaacaagggaacaaatcccccctgtccagttgtatctccaacaccttctgtcaaagaatcaccaagtgccacatatcgaaaactgattttttctgatacggtaagctcttgtctggagatgcgagatgaggcaacaggaatgagctgatgaaatagaaaaatcgaccctagaattgtcagaaaaaagaaaacaaagccttgaatcaacttcctattattcataacgaagcaaaatagcccaggcatcctcaccagtatgagtttgaatgatggaacctgtctctaaaacagaaatttcttttgagacgtactcttgtaattgactcttcatttcatttgcaaaatctgccgttcctgaataggaaataccaatctcggctacttttttatctgctagagttgccgtgaactcttccagccattttttaaaggtcttattgcctcgtcccttgacaatcggagtcagctgatggtctttcatttccatgatgacacggatattgagtaggctactcagcatcccttgaacacgtccaatacgaccacccttgactagattttctagggttgatacaccgatgtataattccgttttttctttgactgtttcaatagctgcaaggatttcttctttgctggcaccagcttgtgccatgcgtgctgcttctacaacttggaatttttcagcctgatctgtaaagcttgaatcgagtattgtcacatcagcaccagaaagggttgctccttgtctagcagcttctactgtccctgacaaggcatgcgacaagagaatggcaataatctgactgccgtctttagccaattcagcaaaagtttccgcaaagagtcctactgggggctggcttgtttttggcaagtttttcgacccacgcatgagctctaagaattctccttcttttaaatcgttgtcagagtatacgactccgtcaaccattacagataatggaacaactgttatattcaattcttcgaccaaactgggttcgatagtcgtacttgaatccgtaacaatcttaatctttgacatatttcatcctacaattctcttcaattttgccatctattataacaaattttaactaaaaaataaactttggacataagcaaaaaggctagtcgcctaacctttttctactaattcttttgcttgattacgggctgcatctgtgattttgtcaccggctaacatcttggcaatttcctcaatacgctcttctttggtcaagagacggacacgagaaacggtcgaatgttcgtcggatattttctcaataaagaactgataatctgcaatagcaatgacttgtggtagatgagaaatcgccaatacttgcccatattgtccgattttataaattttctgggcaatggcctgggccacacgtccagacacccctgtatccacctcgtcaaagacgatggaagtcttgccttctttacgggcaaaggctgacttaatggccaacatcaagcgagacaattctcctccagaagccaccttaaccagaggcttgaagtcttcacctgggttggtagagatgtaaaattctactgtttcatttccttctcgattaaattttcctttagtaaatcgaacttggaaacgagctttctccatatacaagtcttgcaattcttggcggataatatcttctaaaacaacagccaattcatggcgtgattggctgagctgacctgctcgttcaaccaattctttctctaagttcttaagctgaacttccaaatcatctccagataaatcattgcctgtcaatagattgtattcttcgctgattttactaaaatagtccaaaacatcatcgacagttccaccatatttcttcgtaatggtattgagcaaatccagacgactttccaattgcatgagacgattgccgtcaaaatctagattatcgaccacatcgctgagacgcttggttatatcttcaacgacataataagcttctgtcaggctagaagagagctgtttgtagtctggatcaaattcttccagactttgcaagtcactcatagctgagcgtaggttgttcaagcttgaaaaatcttcattgtctaacagtgcataggcattggtcagtgtatctgcaatttgtttgtggttgagcagtttatcgcgttcctgattgagttgaatatcttccccagacttcaaatccgctgcttcgatttcagcaatttggtattctagcatctcaatccgcgccttgtgttcttgctcatttttttgcttttcaagaactcgtttgcgaagactacgataggcatcaaaggttgtctgataacggtctttaagactccaaaattcatcttctccgaaactgtccaaaagacggatatggtgctgggatttcatcaattcttcctggtcatgttgaccatgaatatctactaaatattgcccaatctgtttcaagacagataaattgaccatttgtccattgacacggctgaccgaacggccattttgcaggatttcacggcggataatgagttcgtcagctacttcaatcccctgttcaagcaaaatttgctcgagagctctgctattttcaaaggaaaagagcccttcaatctcagccttggcggccccatgtctgataacatctgtcgtcgcacgcgcccctagcatcaggttcatggcatcaatgataatggatttacctgcacctgtttcaccagataggatggtcatcccgttttcaaaattcagtgatacctgctcaataatggcgaagtttttaatggacacttctagtaacatggctaccaccctctaaccgtctgttcgatttgcgaaataataccttcgtttgtaacaatgagcagaatactgtcatcatcagcaatcactgaaaaaacatgttcttgaaattgttccaaaatctggcgtttgaccacagcagagcttccaggtaccagacggagattaatcattttatccatcactgagacttcaaaaacattctgcgattttaccttaacaagacctgcctttggtaaaccataaatatatcccttatctgctgatggaaccttaataatgccaagttccttgatatcacgtgaaaccgttgcttgtgtcgcattgacacccattgcttctagacgttcaacaatttcttcctgtgtatcaataggaaatcggactaccaaatctttaatgacttctaatcgttctcgtttattcatcctttttaaattcctcatgtgcttgatagactgtagttgttatgacctctttatcaatctggtttggttgtgttgatttttctaagtgcgctaaaaattcgatattgccatgaccgccttgaacaggggaaaagctaagggctttgactgagaagcctgtttccacggccatttttgtcacttcttccaagactttcaagtgaacggatttatccttaacaatgccatttttcccaatctgttcacgtccagcctcgaattggggtttgacaagggcaacaacctggccaccctccgctaaaatacgatggagtgctggcaaaatcagactcaatgagataaagctgacgtcaatggacgcaaaacttggttgaccaagttcgaaatctcccaactcagcatagcggaaattgtactgttccatgctgattacacgttcgtcctgacgtaatttccaagcgagttggttggtccctacatccacagcatagacctgcttggcaccagcctgcaacataacatccgtaaatccgcctgttgaagccccaatatcaatcgttgtttgaccctcaactgataagtggaaaacctgcaaggctttctccaatttgagaccaccacggctgacatacttgagtttttcccccttgagcttgagttcaattccctcgtcaatcttctcacctggtttatcgtagcgttccccgttaatgacggatataactaagccagccataacaccgcgtttggcctgctcccgcgtctcgaaaagcccctgtttaaaagctagtacatctactctttccttagccattgattcgtaaactttctatgatttctttgattttttctgttgaaaatgggacttgtttagccacttgatctagctcgttgattgcttgattcaagctatcttctagaaagacttttgaggcttccagtcccattagggcagggtaggtagacttctcagccaatacatctttttggggagtttttccgatttcctcaaaagtggctgtcacatccaaaatatcatcccgaacttgaaaggctagaccaattaattgacccgcttgtcgcaaatggttgattaccacatctgattgtcctgcaatcaaacctgctgctacaaagggaaatgtcaataattttccagtcttattggcatggatggcttgtaattgttctaaggtcaaattctgcccttcaccagccatatccaagacttgaccagcaaccattccaaaggtcccagatgcctgggaaagctctctcacgagagcaaggatggtctcagctggtaaatcaacttgggctaggaaaccaaatggatctagaaagagactgtcccctgctaaaatagccgttgcttcatcgtaaaccttgtggttggtcaagcgaccacgacggtaatcatcattatccatagcaggcaggtcatcgtgaatcaaacttcccgtatggatcaactcgacacatgctgccacttggtaatgagcttgttttaattccatcccaaaggactctaagatggtcaataaaagcaaggggcggattcgtttaccaccagcctgtagcgaataaagaaccgattggttgaggcgttcagctacctggggttggtaaaagtctgccatggcttcctcaagtcgctgcaatttactggcaaccattaatccatctccgcttcactgccatccgcctgcatgaccttgaccaaggtcttttcagcttctgctagtgtcttttgtaggtctttcgatagaaccattcctttttgaaactcggccagtgcttcttccagagccacatcgcctcgctccaatttggttacgattccttctaattcagctaagttttcttcaaatgttttcgtctgtttggacatgttttacctccacatcaagttgaccatccttcatctggatggttaggttttcacccatttgtacattttctacactatcgatcacccgaccatcttgacgaatcatggcgtagccacgggctacgatgcgactggtatccagcatagtcagggcctcaatcagcttgtccgccttggccatcttattgtcatagatattagccatattgctcttcaagagtcgttcctgctggataattctctcttggaaactttctactttacgacctggatgcacaccttgtaatcgttgctgtagtaggagacaagcctgtttctgctggctgtagagttctttcatccgtgtctgcaattgattggtcaagcggtctaatttttgcaaataaccatcatacaagcgttcaggctggcggaacatgactgactggctaattttctcaagctgacctcttaggaatctcaaacgattggtcatggcctgataggctctattttcctgctgattgaggtagcccagtaagtccgccttggtcacaggtgttgctaattctgcggcagctgttggggtagcagctcgtttatctgctacaaaatcagccaaggtcgtatctgtttcatgacctacgctggaaatgattggaatacgggattcaaaaatagcccgaaccacaatttcttcattgaaagcccaaaggtcttcgatagaaccaccgccacgaccaacaatcagaacatccaagtcatcccgttcattggctctttgaatattagtaacaacctcctgagcagcaccatctccttgcaccttggtcggatagagaacaatctctacgcctggaaaacgtcggctaacggttgtaataatatcctgaataacagctccactcggactggtaatgacaccgattttcttggtaaaccgtggcaaggcctgcttgaattcttctttaaataagccttcctgtgtcagagcttgtttgagctgttcaaacttgattgccaaggctccaataccatctggctcagctttttcaatgacaatagaataagaaccatttggttcatagagctgaatgcgcccaatgacattgattttcattccctcttcaagctcaaagcccagattcttatagacgcctgcccacatggtcacttggatgactgccttgtcatccttgagcgaaaaatattgatggctagggcgtttacggaagttggacacttgacctgtcaaatacaccttctccaaatacggatcgcggtcaaactttaattttaaatacttagttagatgactaaccgataaatattcaaccatgtccactccttctatattgtatccctactattataccaaattttgcacttttatacagaactaggcctattatttccgatagctttcctatgttttttttcaacaatttgctatataatagtttgtgagaaaataagaacttgttgacaggttctaaggagatttatatgaaaattgatgatttgcgaaaaagttctaacattgaggaccgcaggggacaatccagttctaactcatctttctcgtctggttcatctggcggaaatgttctattgggactaatcttttcacgacttggttggaaaggaaaactacttgttcttgtccttttagtagccttcggaggcatgtcaaaccttggtgggttgctttccccatcaacagggactaatccttaccaatcgagtcaagtcacaacgactggtacagatgtgtctgatgcagatgctgaattcatgagtaaggttttaggatcgacagaagatttttgggtccaagaatttaaagccaatggtttaacctacaatgcaccgactatggttttctatactaaccagacccaaaccggatgtggagttggttccgcccaagccggtccattctattgctctgctgaccgcaagatttatattgatacttctttctatcaagaattatctagcaagtataaggctgctggtgactttgccatggcctatgtcatcgctcatgaagttggtcaccatgttcagaatgaattagaagttcttggggcctaccatcaaaaacgggctcaactatccgataaggaaggcaatgcgctaaatgttcgtttagaattgcaagctgactattatgcaggagcctgggccaaatatgttgatggacaaggcatcttggatgctggtgatattgacgaagccatgaatgctgcccatgcagttggtgacgatactcttcaacaggaagcctacggccgtactgttccagacagttttacccacggcacttctgagcaaaggaaaaaatggtttaatctcggttatacctatggtgaccttgctcacgccaatacattctccgtagagaaaccgtaaacatccatagcctctcgtagcaataaagaaactcttgcaacatacacttttgcaagagtttctttataatatacaactgacaaaagccaatttacacatacggtaccacttttaaatatgaaaactgaatcatgtaaacttactcatcaactctaattagagcggtatcctagtttcaaacaatatcacaattattatttagcaaactttaattatttccagttatctctgctgcagactgcacagttccgtttggaataatcactgttttcaacaaattattttcctcgtgaatacgtctgtataagataaccatgtagactgggaataagatgagaaaactatatgttgcatgacacaataaagctaaaccgattaattctggtataatatttaggaaatagttaggatgctttacaacacgaaacaaccaatgatcaacaaaacgatgatcttttaccaacatgagcttaactgtccaaatatcacctaacaatcgtgttacccaaaataacattcccattgaaaacagcaagaatatcaaacctaagctactaagcgtatcaaacttggtgtgtcgcactactgcttcaaccaaacatgataaataaaatagaatatgtacaattgttaataatttagtattttgaacaccaaattctgaaccgccgtttttcaaaatccgtttttcgtttttaattgaaatcttcaaaaaatagattctcaccaaaaaaacacaaataaccaaaaaaacaatcataaatccctcctgtattttaacagattttatcaaacacatccattatacaaagttagactgtcgccattctattcctctcctgttttttttctattttccatttgagactacaataaaagagacctgttttcaaaaatggatgaaatcatgtctcttttatagtcttttagtttacttttagtaccagtcaacgagctgcagacagcttgtacagtcgagtgactgtgcaaggttggagatagcacttgcggagcaagtcacccctgcagagtacagcaaagcgagttcaaacaatccagtggagtgtttgaagttggaaataaggaaacggagtttcctcttacgtcgaagtaataaaagaaaaactaaatattgtctatattttacctatatcaattcattactattcgctgtactttgtgattgcaaatgaatcataaaacgcatagtttgtgtatcagaagcataaaaagtgtacggaaagccgtgtttttctaatattttctgtacaataaacaaaccaatccctatgccaccatctttcttatcacgactgtagtctggacgatagaatggacgaaagacttgatccaattcctcgtcacttaaaacacgttcaacctgattttcgattattaattgattttggcgtagtactacacgaataatagcctctttacatgagtaccgaaaggcattatctaaaatattcttaatagcttttaagaaataaacaggatttgcctcaatgagaaccggtgatagttctacttcaaattgatagcccttaacctctgccaaactctgataacttgttaaagaggaatcaatcaactgatctaatcggatttgttctctgctttcctttaaagccatatcaagatttgtcgcttctaaaatagaatgaactaactcagattgttcctgcaagatttccttgcatttttttaaatatgtatcatggtccttaaatggccccacattataaatcatgccttcgactaaccccaacatactagctattggagtttttaattcgtgtgatgtgatacggaggaaatcagacttctccttctcacgtgccatagcacgttcattttccgttcttaattcatcgatacttgacaataacttgctatacaggctgttaatatcctgagccaatattgttatttcatcagttcctgcaacagcacaactgattccagactctaacgattgcattcgtcttgttgtttctgaaattcttgctattctacgagtggacagtctactgtaaacaaaagctaccgaaactgccagaacaataatcaacagcaatatgaatggataaaaagttaccaatgtttgactgacatcagataacgagtgaaatccataattaaataacagataatatgtaactccttctgcagatgttatctcggctccccaagaaccaatttcatcaaaatccccattttctaaatactcgttctcatgctttttagccatttcatcattggggtctggataaataatttttctatcactcgaaaaaagactaataataatattcggagtttttatgtcgaaatcatcaatctcagatataatcttagcttctggcatcccatccaattgtttagccacagtcatataatcgtgtctcaattcctgtttcttaacctgattataatatataggcatagcataatacaataaccctaacaatgttacagagatgaaagaaatcatcgcagcaacaataataaaattttttctggcaatccccatattaagtaccctctatttgataaccacgaccaactattgtcttcaaaggaagtgacggcaatttcttacggatattcttgatatgattatctaagacacgactatccaattccgtatatccccatattcccatcatcaagttatcacgactaacaattttcccacgtcgtttagctaaatatagtaaaacttcatattcttttttcgtcaattgaacttcttcttcttccatataaactgccccgctagttggttgaataagaattgttcctatctcaatgctatctgtctctccttttcctctcaaaatattctcaatccgttttaccaatatagttggtgaaaatggtttaacaacataatcacttataatctgattaaaactaataagctgtgtatattcgtcacccatggctgtcagcatcaaaattggaatctgagaagttttgcgaatttccttcagtacttccaaacctgtcatagatggaatcatgatatctaaaacaattaaatcgaattgttcttcttgaaacctttctaaagcaacctttccatcaaaaacagattctacctgataaccatgttcttttaaaaactcacaaacaacttgactaataactatgtcatcctctacaaccaaaatccttgacatttttatacctcctcgtaaagttctattataaaatattattatacttcaattatataccgattcgtacaatggtgcaactctatcatagataaatagagcaccatgttctgctatttcagctttcttttgacttcttttgtttaaaacagataaaaaacagacgaaaccgagagcatatatagatttgtttgataaactgaactaaacaaaaatgaaaggaactatcccattatgtggagtccaaaaaaattaaccgtattaaaatggtttgatattctcattctaacaattattttatttggagatggaatcatcaactctactctccaatacatagccttacaaaatcaaactacaactcttcaagaaaatttgacattttcaacaatggataattataaggctttggctctacagttagtttggctcacaatagccatcttctatctattactccgaaattttgatttctcaatttggaaaaaacatatttttattactccttgggttccattacaagctgttgccttattcattttttctgcattatgcttggatatctataatctagtatcctatcagtttctagcttccaacactccatccatgtttcaactatttcctaacattgatttatcactgatcttgtactcattgttgaacggattttatgaagaaattttcttccttaacttgtgcttactggttaaccctaaatatgcaaaatgggcatttttatattcgttaattattcgatgtagtttccatacctatcaaggtttacttagtgcactcggtttaggcttaattctaggaactattttctatctactttatcaaaaaataaaacctaaaaatttattaccatttttcctagcacatgctgtggctgatgttatcggtttaactattctatcatatattctatactagttatctaacagataatttgaacacaagctatcctcatatcaccaaagactgagtggacccctactagtcatgaccacccgtgaaaacgggtggtttattttgtgtaatttaggaaaagagtgccaaaaaacgcataaaatcgtgttgctaagaacgttgattttatgcgttttattatatgacttatctcaatatttttattgaaatttatatttatgcccaactatacttctcagaatcaatgtccatatctcatctcagcctagtatagattgacagatttattctacattcccagttcagcctctgcagctattgcgaatggctcgttttatattcaatctccaaagatttcctaaaacttggatctgtacggagggtaaaacaattccatcactattataggcataatctctactctattaaccatatgtatatacaagtagaaattacacgaccaacatttacttcgattcttgcttacgttttgtacgataaagtacctgagctcctacaagaagagagagggcagttaacgtatagattggagaatcagcttgtccagtagatggaagcgagtttgacttctcggttgaacgattcacactagatactttctccacattgtcagaaagacgtgatttctgattcatagcaagctctacctgatttgccaccgtttcggcattcactttatccttgatagtagaaattggagcagagttatctgaatctttaatagtcttagaagaatctggagtatcactattttctgctttaccaatctcttcagttgactctggttccattgggcgagacaaatctggggtatccattacttttggaatatccaatttttgtgtacctgctgaactgtctgtatcttcgataggcttaggtgattctggtttaacactgttttctgtttcaccaatttctttaggtgactctgacttcattggaaaagtggaatttggaataataatattgtccgttgctttcggaattgttgagtctggtttatttgctgaatcatcggttgagtcttcgataatcttaggtgattctggttcaacattatttcctggtttttcggtctcttcagttgaatctggcttcattggaagagtgggatttggaataataatattgtccgttgttttcggagttgttgagtctggtttatttgctgaatcatcggttgagttttcgataggcttaggtgattctgtctcaacattattacctggttttccagtctctttaggtaactctggttgcattggaagagttgagtctggaacatttggttctgtctgtttaggcatttcaggtgtcaccataggtgtcatattttctacttttgatatacctgttgacttgtctaccaccttatctgtatcttttggctcaataggaacaggaaccaaaactttcttagtttcatggttaagagacacttttgaggatgagtattttgctgttttttctctatcattattaagagaataacgaacctcagttcttaccaattcttggaaacctttattctttttattttttttatgttgcaattgatatgttaaagatagtggcttgttagtttgataagccttgattaagtcttctttatctaagttccaagtaatagttgttttcgagttagagaaaaacgaccataataaactagatgtaccatttgtgatttttactttagaactatctggttttttcgcgaactcaacatcattttcaagcgaatctactaagctcactttagtcaatacatctttaaatttttctgcaacattctcgtcaatatttaaaaactcgcccttatccccagacatttttttcaagtagtcatcaaatttattcttttcttcgccagctttgtctttggtcacatcaacagcgtagaaatgaatccctttctcagtagcaatctttgcttctgcctgagcagagaggttatgattgtaaaagacattttttcgaccgtagaaaatgtaatcaacgagggaatttgcaaacaagtcaattgctttttcagaggtatttgtcaaaccaatctttttaccgatataactgagagtatttgtaggcaatgcagccttatctaattctttttttaaattatactttattttctttacaatagcgtctttaaatggtaatggatcaagtttacgttcataaaagctacggaaatggtacccctcaccaatttgtttctcataattgaatttttgttcttctaatttggagctatcaatatcagctaagtcaatatagtctaacgggtttctgaaaaactttccaataaagtcagttaaacctgcgacagtagatactccatctaatgcctcattaaaccttgtaattcccaatttattcaagaattcaatcaagctcttggcatcttttaacaaatttgctctgcggacagtcacatcaaatgtaaatggccaaggcaatagagggttagtatgcaccactttatcttcattgattgtcttatacttagtttctgttttcgcagcatccgtcaaatcataactaaatgtagactccccttgtgacagaagtacaatatgtttgcgtttccctgatttctcgctttctaaaatgcgacgtgcttcatggattgctccctgcatatctacgccccaattgtaattttgttcagcatcagtgaaaagcttctcaaccgtgtcttctacagtaatactgttaacctcttgagcttcagataacttgcgattgaaaccgatcacacgcacagagttacgagaattatgattattggttgggtcagtcatttctttgacaagcttgacaatgttatctttagctgcttttttagcctcttcatccatttttttagatgtatccaccaagacaactatttctgcacccttatcaatttctttcggcacaatttgagttgttactgtgacaactccatcttgccctacttctgctgttcgagaaactgtaaaaagctctttaggagttttatccactgtactagatactgtttcatttggtttttcaaccttagtagaatagtcatctacttccttctccacatactgaacggctggttcttctttttctgttgcttttccttcagaagaactagtgttttcagcaacttgccccgttggctctgaagcgttttcattcgttaatgcctcaggagaagcagattctgcattcgattttggtaaggcagaaaatagaagaggagtcaaccacctctccttccttattttcattagcttggacaactttagggtcttcaacagcaataggacgtgtaatcgaagaagtattatctatctcctcattttttttctaaagtagtactttctgtaacaggcgtttctgcatatactgtcactgtattttgaggatagagtgttcccgataaagctacccccgctcccagcgaaacaagtccaattgatagcttccgcaaagtgaattttggatgattcattatgattccttctccttgttctctataaatttagaatgtattttcgcccttctttaggtattttcaaaaaaggaagtatggatgtcaatggtaaataactttagtatcattttgttcaagaagcgtagagcttttgggaaaagaatgggcaccttgtgtattcataaggtgcctaagtccttctgttaactgcttacttcacctatcaagtcaagcaagcatgattacaactcaaagttcctatttatcattaacaatgaccatatcacaaaatgtgcgagtctattactacataattcattctaccatataatttaaaaacagaatttgttttttctctatcgtttgtttatgtttattctattacaaaaatgataattggtctttgagtctgttatcacacacatttatacaagtgataaatattgcaatgagtcttcaaactctactttcacctctataagcaaataattcattgaaagaaaaattttaactcttttaatttaaagctacacaatgcctctcatctgtcgcaaacgaatttttgagagagctttgtcatcgccttttactcactttctgttatctttttcttgccaatgaataaagcaaataagaataatatgatcgataacattatattggcaaccaagctcgttttttcaccggtcttaggcaggctttgaacttgggtattctcaccactatcatgcacagatacgtttccttttgtccctttgtctcttacagtacgagccattttctcttgcttagtaggcatatcttttttcgaatcatcaaaaatagaaaccgtttcttcttttgatggctctgcattttgctctacttttttgtcagtcagcgtttggcgtacaggtggcaaagtagtttgctcaagtgtgtttgattgttcgatatttttggtaatttctttgctaggttgctcttccttctcgtcctttttatctggtttattaatgcggtgaccatttcctttttgaaccgttacgacttcccaagctacctgttcaccttctttatcaaacgctctaaacgataaggtttctccattttttaaaacacgactacccaaatcaaattcgaatcgacctgttgaatcagttgaagttttaccaattatctcctcgccattctgagttgatactagttcaatcattacatctggagctgttttgccactgatgtaaccatgatctgtagtgactttttctacttgaaatggtaaatccatcacgtcttcatcttccaaatattgccctacaacttcttccttactagcgatgatattatttgtaaccgggtcaatgatttcaaagcgaattctctcacctttttcaaaaggcaattgtaaatcttgaatttggaaaccaaaaaatcctaattcgtccacttgaactggaggatactgttttcctttgattgacgaaaccatgcgaacgtaggcattaagatgtatcgttcgaccgacaatataatcttttttattatgcagtttaggtacaatgataggatcttcatctgtcgcttcatccatatctgcatcttgtaaataagttgctaaagatgccataacagatttatccaataatatacttgaaccatcaactgtatcaagatggacagataccaagtcctcttgttgattgtgagtcaatctgtagtacttatcctcggattgtagggcaggcaaagcaatcttatagtgacctgtctcatcagcaatagcttccatgataaactctgaagtatcagcattgtatagatgcacacgacctaaaggaaatgtagttccttccaaaactgaagtcgcacttgataaaggttttactgtcatttgtgaagatactttttcttttaccaatggttttacaatagtattagtaatcaccggctgaccatcttctgatacaaaagacaaaaccaatctatcatctgctttaaattttgaacctgctaaactctcggaaaaagtaacctcaaaccgtccatctttaggatcaattagtgtcttatcagagacaaaactaccatttattgatagatagactgaacctttgacagaggtatgaccaataactttgctcgtatgttcaaaaactggttcgatgaacacttgatgcattccattagatgttttttctaatctttttgctggaatttcataagcctctggatgtcgattagtcctcactactaccttacgctcttcagaatctgcctctagagtccaaaactgtttcggcaaagcactaatttccacagtttggctgtgagcaagtggtttactcaaccgataagaaaaatctcccttatcatctgcttccaaaatattctcaatagaagtaattgcttccccatctatcgtaatcgctacatatccaccaggagtggtattccctgagatggtttgatctccagcttgaatcggagcaacctctagatggttttcaataaatgaaagttcttcctccatatcctccatctcttccgattttttttcttcactcggtacctcatcagccacttcctcagcttcagcattttccgaaactgtattggtaagcgatgattccgtgctttctaattgagtttcaagagctgtagcgtcagtctcctcagccattgcggtttccatattcatccctgtaccaatccatagaaaagcaattgccaccgaaactaaacccatcttactttttctcaacgaaaaaatcttgctattcatcttttctccttatatctgtattaacaattaacgacacatattgtcctagttttattataaaaaaaacatctcatagaacattgtttttcattagttttttatctgtttcacagttgtctgtaataaatagcatgctacatttcgcaaaaactttgctggttctcatagtcatttagtttttcttttattacttgtaaatacaatttctaagttatggcacattcaaagtaaagaacaagcgcctgaatttttctatgatgcagatcattgtttttatctcggagtgctcgctttaattcgtcaacttatactcaatgaaaatcaaactaggcgatgcatatgcagatagaactgaagtttatcaaatcaagtcaacaatgtctgattttgattttcgaagagtattaaataggagtgggtttatttgtcatgatgccacttgtttattttgttaactatcacttcataaaacatgattgtcctcacaataaaaaaagcacccgaaggtgctaggtaagatcatcctaccgacttcacgttgaggtaggtagaaaaattcattaggcgttgaaagcgtcagtcaactgtggcaccacttgtttcttacgtgaaacggcacctgcaaggaaggcgtggttgttttccaacttgaagttgaaggctgcttctaccttgtccatgttgctaccgagcgcaaggatttctgagtttgagttaacgatgtctgtaatcatcaaaacaaagtcagagtagccatttgctactgatgctgctgtcatagctgcttcgatttctgcttggcgttccaagacttccgcaatgtccactgtgttaacttgggctacacgcacgtcattgccattcaagccaaatgttttggcatcgatgtcaatcaattcttctgctgacttgctggcaaggttggtaccagctttcaagagtgccaaaccgtattcttctaagttgacaccagcaatttcagccaattcagctgctacctgtggatctgttacatgagtagttggcgatttaagcaagagggtatctgaaatcaaacctgataggagaagtccagctacttcttttggaggtattactccgttttctttaaaggcacggtaaacgattgatgatgctgaacctactggctccaaacgcatgtacaatggatttgccgtttcaaagtttgcgacacggtggtggtcaatgacagctgccacttccacttccttgatgtctgcgatagactgttggaattcattgtggtcagtcaagatgacttggctaacaccttctgcttttgcagactcaaccacgcgcggtgcagtaacaccaaaatagtcaagagcaaaagcagtttcttcatttggcgttcctagaactactgcttccgcatcacgaccaaacacttcacgctccaagtgagcccagccgtatgatgatgcaatggcatctgtatcaggattttggtgaccaaaaactaaaaatttagacatgtctacaacctcattttttctaataatctcctacattttaccataaatagaaagacttgtgaacatggacgggtcgggatttgccaaacgttttcaaaaagagtaagatagaaggtagcaatacaaaaggagaaacatatgaaattttcagactatacctatgtccgtccagattatgaagctatcaaggctcaatttactgacctgaccgaccagttggctcaggcaagtgacttggaaacaactcgcacacttgtggcagccgttaccaaattactcaacctggtcgatacccagtacaatctctggatgatccgtcatactattgacatgaacgatgagttctacaatgaagaaaccaagttttggaatgaatattcgccactttttgaagaattgaccaccaactactaccgtatcattgtccagacgccgtacaaggaagaactgtcagacatcttgcctcaaaccttcttcatgcaggcagaaaacaagctcaagaccttctcatcagacgtcattccattattgcaaaaagaaaatgaattgaccgatgagtacagcaagctgattgctggtgcagagattgatttccaaggtcagacctacaacttgtcacaaatggggccattcggtcaatcaaccgaccgtgaagtccgcaaggctgcttctgctgccacaactaccttctttgaaagcaaggaagctgattttgaccgtgtttacgatgaattagtaaaagtccgcacagaaatcgcccacaaacttggcttcaaggactatgtggaatacggctacctcaagatgaaccgtttcgattacaatcgtgacatggttaaggtttaccgtgaagaaatcctcaagcatatcgtaccgattgtacaaaatctgcgtcaacgccaagccaatcgcttgcaggtgccaagcctcaaacactacgacctaaaccttgagttcttggatggaaatgctgttcctcaaggtgaccccgactttatcgtcagccaagcccaagacatgtaccgcgaattgtccgcagaaacaggcgagttcttcgatttcatgattgagcatgaactcttggacttggtcgcaaaaccaggcaaaaacagcggtggctactgtacctatatccctgacttcaagagcccattcatcttctccaacttcaacggaaccagcggtgatattgatgtcttgacccacgaagcaggtcacgccttccaagtctatcgttcgcgttggattcaaagtccagaagttgtttggccaacctacgaaacctgtgaaatccactccatgtctatggaatttatgacctggccatggatggaccgtttcttcaaggaacaagtggataaatataaatttactcacttggcaagtgcccttctcttcttgccttacggtgtcttggtagaccacttccagcacgaagtctatgaacgcccagagatgacaccagcagaacgcaaggcaacttggaaaaaactccaagacctctacttgccagaccgtgactattccgagtcagaagccctcaaccgcggtatcttctggtatcgtcaaggtcatatctttgctagtccattctactacatcgactataccttggcccaagtttgtgccctccaattctggaaacgtacacaggtagatcacgatgaaaatgcttgggaagactacatccgcatctgtgatttgggcggcaccaagtccttcttgcaagtggttgaagccgcaaacctccaatcaccgttcaaagaaggtgcccttgaaagcacagctaaagctgctgctgattggttaaatacagttaaggatagcgacttataaaacacaaaaatctgaatgaatcaaatgactcattcagattttttgattatatgatacttgtccctaacacattaaatctttttcgcatcaatctccgacctcttcactattatcccttaattctattcaagtactcctgataggtctctgtctccatcaaggcctttgcattttccactcgagccttcgttgggggcttggtcccctctagtggatagggtctgcccaactcacgccacttaaattcaccaagattgtgataaggtagcacctcaaaacgttcgacattttttaaggttttaacaaacttaccaagttcaatcaagtcctcatctcggtcagtcaaatttggtaccaggacatgacgaatccaaacaggcttaccaatgtctgatagatattgagcacattctaaaatagtcttgttactgtgacctgtcacaatgcggtgttgctcaggattcatttccttaatatcaaggagcaccaaatctgttacttccataagccgactatatttttccaagtaacgctctgtcttacggaaagtcaacgcacaggtatccaaagtagtgtgaatccctttttcttttgcaagggtaaacagagcaattaaaaaatcaatctggatggttgcttcaccacctgaaacggtaatccccccttcttttccccaaaacatacgaaaacgcagagcttcattcaagacatcttccgccgttctctcagtcgctgctggattgaccagatcccaagtatctgggttatggcaatactggcaacgcatgtgacagccctgcataaagactacaaaacgtacccctgggccatcaaccgaaccaaaactctctgttgaatgaaccaaacctgtcactttacgataatcaatttctgtcatcatctcatcctcatcattttataagactagtatatcacaaaaatgaaaacgcttctatcatttactttctttctttcataaccatcatcttccgcaagaaaaaagctaaaagactaggttgccctagtccttatcggtttcttctttctccagtggtgtaatcaagagttttaattttgttacgcgaccattttttaccttatcgttaataagaactaggtggtgatctttactatctacttcaaaggaaactttctcatcttggctcggaatggtaccgactcctgtcagataataaccagcaatcgtatcaacgttatcactttccaactccatctcaaaatgctcattgaagtcattcaaggtcatatttccttggacgatataggtgttgtcagcaatttctcgaacaaaaatttctgtcttatcggtctcatcatcgatttccccaacaatttcttccagcaaatcttccaaggtaacgagacctgcaactccaccatactcatctaacaagatggccatttgattttgggtatttctcaatgatgtcaacaaatcatccacgaaaatcgtttctggaacgaagagaggctcctgcataatgcggcggatgttgagattgtcaaagccattactgaaagcttctgacaagattttcttggtatgaatcagaccaatgatattgtccttatcgccatcataaacagggatacgtgaaaaattctgcttgaggatagctgccatgatggttgctgtatcatcctcaatatccaccatgaaagcatccgtacggggaaccattacttcacgtgccatcagctcatctaaagagaacacaccttgaagcatttcgatttcttcggcatctaaggttttctcactctttgtcaaaatatattcaatttcatcccgtgtcatttgctcatccgcatcatcaaaattcataggagtaatacggctgataagattcgttgcagctgataataaccacacgaacggactaacaatttttccaaggaaaataatcactggtgcagtgactactgccagattttccttcatattcatggcaatccgcttaggatacaattcgccaagaacgattgaaacgaaggtcaacatagccagtgcaagccagtaaccagcagtttgagctgttgttgaattccccatccatttggcaaatacagctcctaaatcattagccaagctggcacctgaaaggatggagatgaaggtaataccgacctgaatggttgatagaaaattgttaggattctctaaaacttgaagcaagcgaatatatttcctctcaccgtctgctgccttttgttctactcttgaacgattgagggatacaagggccatttctgaggctgaaaagaaggcattgaacagagtcaataagaataaaattaacagttgtaaatagatggtctgactaccagggtcttccatgatgttctcctataataaaatttataacatttccattataccacaaattctaaaaattaacatatttcttgttataattagtccctcatatctgtttatgttacaataatcaaaaggaataggagagcaactatgattatttcgatgaagaatgtccactataaacgacaaggtaaaactattttagaagacatcaactgggaatttagaaaaggagagcgttgggctattttagggctcaatggggctggaaagtcaaccctccttcgtattttaatggctgagttttggaagacctctggtgacctgactgttctgggggtggaatttggtaagggagatattcctagtctacgcaccaagattggggtagttggctcctttttggcagagcgttttccaatcgatttgacggctgagcagattgtcttgacaggaaaatataaatcctccatcctctatcgtgaatacggtcaagctgaattggatgaagccatagacatgctcaaaaccattaaggctgagcacttgatcggtcgggcctatgctagtttgtcacaaggagaacgccaactcctgctgattgcccgaagtttgatggaagagccggctattttgattttagacgaagcaactgtcggtttggacctcctagctcgcgagcgcctgctccaccacattgactacctctgtcaactcccaacggctcctgccattatctacgtcacccatcacgccgaggaaatcactgataatttcacccatgtcctcctgctcaaagatggcatggtcttggcacagggacccaaagaagatatcctgacacctgaactcctcagcgatttttatggaaatcaggtggaattgattgacttgggtgagggaagattgttcattaagccgatattataaaaaacaaatccagctctagttcgagctggattttaatcgttccaccatgaccaaaaatggtggggtattaacttggttgagcggtttgtagagcatggctgtaaagacggtttggtcaagctggctgataaagtctaaaactgcatccttctcaagagctccaccctcgtgaccatagtaaatcatgatagccaagcgacctccaaccaccaatctattcaggactttctcaatggcttgaagggtggttgcaggcagggtaatgactgacttgtccgccgaaggtagataacccagattgaaaatcgctgccttgcattcatccacatactggtctaggttttcgtgtcctgtcaaaaccaattgggcattggtcaagccagctttttctagtttttcagccgttgtagtcagggcttgttcctgaatatcaaaggccacaacttttcctgctcgttgggctaaaaatagcgtgtcatggccatttcccatagtcgcatcgaccgctaggtcctggtctgttaatatttcatctaaaaaggcatgggccatgtgtaaaggtctaagcatactttctcctaattatcgtcaatacataaaatctatcacatctagtatagcatactttccatcttcaaaaaattttttaaaaatcttccatttttcctattccttttgcgaataaataggtatgaagacaattatcctatttttccttggagcttctatcggctccttcttgggattggtcatcgaccgtttccctgaacagtccattatcgccccctctagtcactgcaatgcctgcaaacgacggctcaaggcctgggacttaattccagtcctatcccagctttcgacaaaatccaaatgccgttactgcaaggcgaagataccttattggtatctgggattggaattcttagccggtctagttgtcctgctctgccattttcaagtcctaaacctaaccgaaaccattctcatcttggcaggactagttttgaccatttacgacatcaagcatcaggaatatccttttgctgtctggctcatttttacttttatagctctgatactctcccagctcaactggcttttctgtggctttttactcttggcctatctgactgaaaaatggcaaatcaatattggttctggtgactttctctatctggcaagtttggccttaatatgtggatttacagaactcctctggattatccagattagttccctcctagggcttcttgtcttcgccattttcaaacccaagtctattccctacgtaccactcctatttctttcaagtattcctatcattctgtgcacctaaatcgagtttttctcgatttttttgttataatagaaggcatattagagttcaactccatcaaaataattggagcaccttcttgataggaaggcaaaaggagaaacgttatgacactatttaaggatgacagtttaaccctgcataccgacctttatcaaatcaacatgatgcaggtctattttgaccaaaacatccacaataaacacgctgtattcgaagtctatttccgttcacaaccttttaaaaatggctacgctgtatttgccggtttggaacgcgttgtaaactacctcaacaatctcagctttagccagacagacattgactatctgacagaactaggttatccgaaggatttccttgattacttgtcccaattggaaatgactctcactgtccgttcggctaaggagggcgacctggtctacgctaacgaacccattctgcaaatcgaaggaccattggcacaatgccaactaatcgaaactgccctcttaaacattgtcaactaccaaaccctaattgccacaaaagctcgccgtatcaaggctgtcattgaagatgagcccttgatggaatttggcactcgccgtgcccaagaaatggatgctgctatctggggtacacgggcagcctttattggtggagcatctgcgacttccaatgttcgagctggcaaaatcttcggcatccctgtcgctggtacccatgcccacgccttggttcaaacatacggagatgattacaaggctttcaaagcctacgctgaaacccatcatgactgtgtcttcctcgttgatacctatgatacgcttcgtattggtgttccagcagccatcaaggttgccaaagaaatgggagataagattaacttcaaaggggttcggattgattcaggcgatatggcctatatttctaagaaagttcgtcagcaattagatgatgcaggttttacagatgcgaagatttacgcatctaatgacctcgatgaaaataccatcctcaacctcaaaatgcaaaaggcaaaaattgatgtctggggagttggtaccaaactcatcaccgcctacgaccaaccagctctgggcgctgtctacaagattgtatccatcgaagatgaagatggaaatatgcgtgacaccatcaagctgtcttctaatgcggaaaaagtctccactcctggtaagaaacaggtttggcgcatcacctccaaagaaaaaggaaaatcagaaggggactacatcacctttgcggacactgacgtcacacagatggataatatctatatgttccatccaacttacacctatatcaataaaaccatcgagaactttgatgcccgtcctctcctagttcctattttcgaaaaaggaaaacaggtctatgaacttccaagcctagcggaaattcaaacctatgccaatcaagaatttgataaactctgggatgaatacaaacgcgtgctcaacccacagctctatccagtcgacttggcacaagatgtttgggataataagatgaacctcatcaatcgtattcgcaaacaaactcagaccaaatccatctaagaaaggtatgttatgaccctacaggaaacaatcatcaaagaattaggcgtcaagccaagcattgaccccaaagaagaaatccgtcgctccatcgactttctcaaagactatctgaaaaaacacccatttttgaaaacctacgtcttggggatttctggtggacaagattcgaccttggctggtcgtttggcccagctgactatggaagaaatgcgggcggaaacaggtgacgattcttatcaatttatcgctatccgcctgccttacggtgtgcaagctgatgagtctgacgcccaagcagccctagcctttattcaaccagatgtcagcttaaccatcaacatcaaggaatcaacagatgccatggtggctgcagtcaatgcaaatgggcttgctatgtctgattttaataagggaaatgctaaagcccgcatgcgcatgattgcccaatacgctatcgctggagaacgcaagggggctgttattggaaccgatcatgccgctgaaaatatcactggtttctttaccaagcacggtgatggaggtgcagatatcctgcccctcttccgccttaacaagcgtcaaggtaagcaacttctagctgctttgggagcagatgaaaaactctacctcaaagttcctactgcagacttggaagaagacaaaccaggccttgctgacgaagtcgcacttggtgttacctataaccaaatcgacgactatctcgaaggtaaaaccatcgaccctcaatcccaaaccattatcgaaggatggtggaacaaaacagcccataaacgccacctgccaattactatttttgatgatttttggaaataatactcctcgaaaatcaaaatcagacgttattgacttgatttgatgactgaaaagctcctgtggaggttttcagcctgttcccttgaaatataaaaggaacagagttctaacatcaacttgaaggcgcaaacaatgttcgctatatttcctagcttcaactatctcccagatagttttgatgcgaaacatgttcgctatatttccaaccttcaactatctcccagatagttgaagctaggctacttttgattttcatcgaataataaaaaatggagccctgacagttgaaccgtcaggggttttgttttttattataacttcaaaccataatgaaaaaagcccacgcaggaaaaaatatcctgcgtgggcgtcaatggacacggtgccacctcactatggactcgactagaaaagtccataactttttctcctctaacaaggaggcgcacgataaggggtgcggaccgaactctcattgtttcgaattcatcgaaccaaactcactttactaaaccagacaatccataaaatggatacgaatgcttgtttggcatcagcctatctcataaacctctatcatctattcacaccaaccatagactctctaaagacaaagtgtttattacattttctgattacttgtaattatacgttacaaaatcaaaatggtcaagtgatttttagaaattttctaaacaatttgaaaattcagtttccattgcctgaatccattaaaaactaacaaaaagccactctgcttaagtgactttctaaaaaactgtactcacgaggctgggctcaagcccagcaccgcttctcaaagttagtgtcaccatctcagcgcagtggttgattgggtttaacagtccagtggagtgaaacagttcggggaactgtttcagcccgatcctagaaagggaaaagcgaggttaaaggttggagataagatttgcgaagcaaatctcagcaattcatgttttacactccaaatctgacctctacgactgatgcgaactttgttcgctatatctccagcctccaaaggttccccgaaccttcggagctatgcggaggtgggagtgaaacaatttgaggaactgtttcagctggtcaccttaaaactagaaagtgaccatagaagccgaacctaaatgtctttcccactcccatatcaaagatagctttagctagtcaaggtcatttttaagggaatactgactgtatttcaaaaaaataacgatatgtagcttaaacaatagcattagatggacattctgaacctgtgacggtaggttctaagactcctgtttggaaaggattatccctctctttatcaatgaatagctaaaataggctagtattccccccattgtattggtccataaatcatcgatttcaaagacgcgttgggcatcaatcagcaaatccagtagtaattgtgtgcattcaataaaaagactgatacaaaaactataacgaatcaccgctcgaaggctccgccattcttccctaagaaacaaaagaagaaaaatcagagggaaaagtagaaaaatgttagtgatgttttgcaagaaaatccaccctaggtccgccaaactatctaccttgtccccgttgacgatgctgttgaaaggagttggtaaaagatagagacggccaatttgaataattcctggggtcgagaaatccttatactgtgggtaccaagtctgtggtaggaaacaaagtaaaacaatagccagagcataggctccagctaaggtcttacaaatctgtcttcccagcttggtcaggttcccatctgcttggaagaattttctcatgctcgaatacctgcctttgcttttgcggctgcaatacgagcacgggctttttcacggtctttcttgagcgtattggagcgcaattgaccacaggcagcatcaatatctgtaccatgttcctgacgaacgacacagttaacaccatttttcttcaaaacatcaaagaaagcaagagtacgttccttggttgaacgactgtactggtcatgttcactaactgggttataaggaatcaagttgatataagacaatttacggatattcttagtcaagtcagccaattcctgtgcctgttccactccatcgttgacctcattgagcataatatactcaaaagtcacacggcggttggtcactttgatatagtcttcgattgcttcaaaaagaacttctatagggaatttgcgattaatgcgcataatgctcgaacgaaggtcattatttggcgcatgtagagatactgccaagtttacttggacaccttcacgtgcaaactctcgaattttcggtgctaaacctgacgtagaaacagtgatgtgacgggcaccaattgccaagcccttgtcgtcattaaccactcgcaagaaggtcataacattatcgtagttatcaagcggctcaccaatccccatcacaacgatatggctaacacgctcattctgattgcgctcatccaagtacttttgtaccaacataatctgagccacaatctcaccgctagtcaagtcacgttgcttaggaatcaatccagatgcacagaatgtacagccgatattacagccaacttgtgtcgttacacaaacagaaaggccatagtgctggtgcatgagaactgtctcaatcaacatgccatctggcagttcaaaaaggtatttgatagtaccgtccttagactcctgtacaatccgttgtttgagcggattaactacaaaatgttcttccaacttttcaatcaaagattttggcaagttggtcatttccgcaaaagattggacacgagaacggtagagccattcccaaatttgagtggcacggaacttcttctctccgttttctaaaatccaatcaaccagattggcttgactaaatgcataaattgatggtttcatatttctccctatttctggcggataacaaagttacgcttcacttcattcatctcacgcttgctttgtttacgctcacgtttttgagaacgctccgtttgactcgccttaacaccagcattcttcatagtaaaatgacgctgttccgactgtttgttttgctgcttcccctttttctgacggtcattgcgattacttttgttttcttttggcgcaataggctccgtccgcggctgatttctgttccgattgcgagaacgactccgcttccgacgcggtctattctcctcctcagcaggcaagtcttgtggattcggattggctaagacgaaataagcacaaccaaaattacaatactccgtcaaatagtcgtctaagcggctgatttttaagtctgatttaacatttttatcgtctgtatagaatccccttaatctcagctgctcattgccccaatctcccacaatataatcaaatttgagcatgagttgtgaaaaacgttgaccaaaaatcgtctgatcaaaagcattcttgtaatcttccaaaaggtccaattcaatattttcagatacaaccttatctccgacacgagcaaaactcggaccagggtatttattatagttatacatttcaggtgaaatttcttttttcatttgtcctcctatcttataaaatcttcatacgtaaaaatcatttgattaataatctatctggtcagaatctaaattctcacacttaaccttatcattataacacgatttatctggaaattcttctactttaccatttaggagaaatttctgacaattataatattattctctagcaaaaaaggacgatttactcgccctttgttttcttcaaataatcaatagcctcttgaacagttttcacaggaactacctcaatatctagacctgctttctcggctgcttccttagcttcttcatagttcgttttagcctttggatttttcttcaaaacttctacatcaactggattgtttggtacaaaaaagatacttgcaccagacttagctgccgaaatgaccttcttatcagccccaccaatgtcacctacttttccatcctgctcgatagtccccgtaccagcaataatccgaccatcacgtaagtcaggctctgcgagttgagtatagatggcaagtgtaaacatcagaccagcacttggaccaccaatatctcctgtttggaaatcaatcggaatcgaactttgaacctctgtatgatctacgagagtgatacctatcccgtttttgccattagacaatttgataatcttaccgtccgcagatttttcctgaccagcgctaatataaccaactgttacatcacttccaacctccaagccactcacatatttaatcaaatcaggagaagactcaaatgtttttccattgatactcacaacagtgtcggcaatattaagaacttttttaaaggttgaatcatccgtcaaggcaagcacatagacaccaaagaaatcaagattgacttcttttcctgccaaggtcaaaccttggtacttcgccatattttgcgatgtctccatgtaaaaccgtgctatacggaaatactcctcattgtcggcccctcctgtcatctcttcagaggaacgaactgtcgtatagggatcaaactgagcagcgaatagttgtaaagctgtagcctgttggactgatacataggtgaagttgtaagagccatcctcttggtctatttgattgttcaccgttagtacctgacgaatatcggcagctccacctggactttccagataataaggcagacgaacaaaaacggcaaaccaaatcaaaagagttcctaaaacaatagatgcaattaaggttaacttcctatttttcttcattctttctaatctcctcactaacaatttctggaacataagggcctatatcctgtttgaaatacagcaattctctaacctggctggatgatacgaacttaagctctggcttggcgattaaataaatagtttccaaacctggcgccaactgacgattgtaaaaatcaaaacttgactcgtattccaaatcggtcgcattacgcaatcctcggaccaaatgtgttactccatagcgcttagctacatcgactaccaattcattttcagacagaacgacctcgatattctccattcctacaaaaagcttctccaaaatggcttttctctccaaacctgtcaagagtcctgcctttttaggattggtaaaaactcccacatataatttatcaaatagtccactcgctcgttcaattaagtccaagtgtccattggtaatggggtcaaatgagcccgtaaacaatccaatcttatctgacatatactgttaccttactaattccgtagagtttctctttccatatccccagctctgctatttcctccggaagagagaccgccttatccgtttcgcagactaccataacatcatctgctagtaagtcacgccgacaaagttctgttatcacatcttcaatttcctgctctgcataaggagggtccaagaataccaggtcgaaaggacctcccacactgttcaaagcctgtctagcttccattgctagaagctgaaatttatctgcttccttagtcattgcaatattttcacggataatggcttgtgctcgtcgatctcgctcaaccagaactgctgactccatgccacgagatatagcctcgatagataaaccaccactgccggcgtacaagtcaagaactctaccaccctcaaaatagggaccaatcatattgaacatggctccacggaccttatccgatgtcggtctggttgtttttccatctaacgttttcagtggtcttccaccatagcttcccgatacaattctcataaggtatattatagcaaaaaatgaagctcgttgctgaaaccaagtgcacttcctgctttcctttttgcaccaactttttcaaccttctaccaaatacactctcaaccgctatagcaggaaattattctcgcactattcaacaaaatgataaaaataaaaagcaaggaaattctgttttacgcgaaattcctcactcttatcgtatgtatttaaactagatcgttacaagaaaaaattgatgttgaaatacaaatagctattttttccagtatgctaatacgccataaagaaccagtagctaaaaagtctacggattatctggtgaactctcgtcagctgttggaactgtttctactgactcaaccaggctagttgttgaatccgtcgtttccgccggggcttcagaaactgttggagtttctaccacaggtgctccttcactagtcggaggcactgaagtacttgtactagttgacgccacgctgcttgtatactggcttgttgaactcacactttgatttccatatatattttgattaggcactacataggattcttgtgaggtctcactagcttcagcaaggtccgttgactgactagtccctgtttcagatacttttttctcatcagctactttttgggctgcttccgctctgaccaactccgcttttagcttagcctgtgtttgagcatctgtctgctgtcccactagctcttttacttggtcaatccgtttctgtaatgctgcttttttagtcgcatccgtaaccttgtttactgcagattgtgcctctgcaagtttctcttcagtatgtgttccttctaatacaatgacagcattctcagcatcctgaaataatgtatcaaccgtttttttctgattggacacttgctgtactgtctttgtatcacttgtttcgctttgagcatttttataccaactagcgcctaagctaatcaataaaataagtcccataaaagaaataatgccaatttctgccaatgacaacttttcaaatttcttttccatattttttcccttatccgtcttattgcataagaaaatactctagcctactgacaatgctacttagttgtttttaccttaccattccatccgtttagaccatagcttaaaatatagatttcgttaaagccctgtttcttcagatgaagggctgcaggcgttaccaactgaccacgatcattctcatagattaagacaggtctgtccttacgcaaagcagctgtagactggcgcaattgctggtaaggaatatttctcgcacctaagatatgcttacgattaaactcactcgggtctcgcaggtcaatcaactgacctccgtgtatcttttctgcaaattctgcattatcaatcacagtcgctgcacgacgcaatctccagtaattaaagcccatccaggctcccaatactgccaaaaatactaaaaatacccaaaatgtttccatcactcattctcccttgatttctgatactctaattccaaacgatgttcacgcctcaaaacaagctctgcttccatatattccaaccgatctaagacacctgcctgatagattctatttaattctatctgcatcatttcaatatcgtagagacggttgcccatatagacaattataccaaaccgtttgagtaattgttgcacatcataaagtcttttcataaaaaaattgtagcagaattttaggtgtttttcaatataatactcaatgaaaatcaaaaacagactagctccaaaggtttggggaacctttagaggttggagatagagcgaacgtagttcgttactacttacgcagatagaaccctgttactattttgtttcaagggaacaggctgaaaggctccactggagccttttactcatcaaatcaagtcaacaacgtctgattttgattttcgaagagtataaaaactcagtcaaaaatccggtctataaaaagattggacaaatgcccaatctcattcgtttatactaaccaacccttttcctgtgccaccttaacagcggcggtgcggttttcggcgcctagcttggacaggatagaggtcatgtagttgcggactgtcccgtcagacaggtggagctggcaggcaatttccttattggacagcccctctgccaccagcttgagtagttgactttctaggttggtcaaagggctgcgttgggttaagagaatatccatcaactctggcgaatactccttccgccctgccaagaccgtctcaatggtccgcatgaggtctgcgatggagcgttccttgagcacataggcatccacatctgccttgaccgctcgctcgaaatagcccggtcgcttgaaggtggtcatgatgacaaccttgacaggcaaggcttgaccccgcacccattccaagacatctaggcccgtcttttcaggcatttctatatctaataacaccacatctactggctctttttccaaaagagcaatggcctggctgccgttttctgcctgtaaaacagcctcaaccgcatcttgaaaacacaagagctgacagagggcgtcccgcagcattgcttggtcttctgcgactaagattctcattctaccacctcctcaaacggaattcggatggacaggcgggtgggatttgccagagaaagaaactccaaactgcctttcaccgtcaccaacctgtcttttatggtatgtaattcctgaccagtcaacttggcaaagcccacaccattgtcttcgtagtataaaaccaattcttgctggtctttttcaaaaaccaaccggcatctgctagcctgactgtgcttgagcaggttattgcccaactctctcagcaccatagccagcttgttctggacaggtaagctgagatgctctgctatttccccgcccaagacaagcaaatccactcctgccaggtccaacatctgctgtaaaatctggagttcctctgccacggtgtactgcttgagggactggacaatctggcgaacatcctgcatggagtctttggctaaggtctggagctcctgcacttccttcttggcctggtcaatctgatcatggtctaaaagtgtctggaccagctcagccttgacagacagcatggcaaagacatgccccagcgtatcgtgcaagtcctgaccgatacggttgcgttcattctcagccagcaggagattgatggacgcattctgctcctgtaggcgttgctgaagggcttcccgcttgatctcaatccagctgaaaatcagcaaggccaagccaaagaagtggataacaagtgcaaaagctctcatctcaaaaggaacagggccaaagagagcccagaggataatggccagtaacaagatcccagaggacaccgtccgataggtcggccgagtttccttgtagtaccagcctagcatattggacaggttaaagatgaagagggaaaattgcagattgccccaaaaactcatgacggcgatatagccaatcaggtaaaaccaagccagcagggaatagagcttgtggtcggtataaaagagggagcaataaaccaaggcaaagagaatagtcgctaggacaactgctgttggattgggactatactgggcatagtaaaagggaaaatagagaaagaccatgcccacgaagaacatgagcggcacctttcttttttcaaaaatcacggcttacctcactgttgctcggattttctattcagaactagagcaattcctaagaaaattatcgcatagcctaggacaattagcaaggatttccagagaaaatctccctcttgggcataggtggtcaccagctggttgacatggtagctaggcataagtttacaaatccgctgcacccagtctggaaagagggaaacaggcatccaagagccacccatgatagccagaacaaagtagagcaagtttgccacaaccgacatggcctgttcagactggatttgcaccaagagcaagccgatagctagaaatacgatagaagttacaaggagtatgagtgcggacacgacccattcctgagctgacaaatctactcccttgaccaagccacccaccgcaaagacaacggcaatggaagatacaaagcagagcaagacccgtaccagtttggataggtagtagtgccagattggcaggggtgaatgctggataaaggtcaaccagctattctttctgtcctctgccaacatcatgggaaaggtgaaaagggcaaagcccgacatggaaaaacctgtcattgtcagcatgtaggactggataaaggccttttgcatggctgcatcatcaaaccggaccgttgatgagaaaatcaggaaaaagatgacgggcataccgatagacaggagaaatactcccaaacttctggataattttaccgcctctacttgaactaatgctttcatgattcttcctccctcgtcttgtcaaataggctattgagcagagttttattctgcacttccaggtctgaaatccgacaacctgcctcctgcaaactagcccaaacctgctcaatagctcgggtcttgaagctgaccgtatcttgtttgtagctgatcccattgatttcagccaagctctccaccaccgccgcaaaggcaatcggcaaagtcacttctttttcttgctcctcactccgcatagcaaatggcgtggtatctcttagtagccgcccctgatgcaagaccaaaatccgctccgccgtatgctccacttcctcaatatagtggctggtataaaaaatagtcacaccctgagccttaagttcatggacaatctcccaaaaacgctggcgggtcgaagtatccatgcccgccgtcggctcgtccaagaagagcaacttgggcttgccaattaggcagatgacgaaagccaagagccgcttctgaccacccgatagcttgccggccagttgatttttttgctcttgggaaaagcagagcaggctgtcgatttccacatctgtcagactatccttgtaaatagcttggaaaaagcggagtaattccttgaccttcaggtctgtcgggatagcattttcttgtggtaagactgctaccgtttctttattggaccgagcctgtggagccagaccgtccaacaaaacctggcctttcgtcgcctttctatcacccaacaaacaagacataagcgtcgtttttccagccccgtttggaccgattaaagccacacattctcctgacttgatttcaaaggaaatagtggacaaaatcgtccgtcctttgatgattttttctagtgcttgtacttctatcatttttctacctcctacttcttgaacatcttatagtcttttagtttacttttagtactaggcaacgagccgcaggcataactggaattaggcaaggcgagttaacgaagtaataaaagaaaaactaaatgacgatacatagacagtatatctcgaaaaaggagaccccactagaagcctttgtcatggactcatgtgacaaatgtcatattatactcaatgaaaatcaaaagtagcctaggaaacgaagtcgaagatagatctggagttcatcaaggcaagttgacaacggataattttgatattcgaagagtattaaataatgtagcaaaaaaagagtcctactgtggacccttcatctatttacaacttaggtgcttgaccaagttctgcctgcagcatccaaatatgtttttcaatactagccttagccacattgaaaatgtcgttggttacgctgtcaccttcttcatcactgacatcaaaccccttttggaaaagagcagccagatagcggaacacctctaccacacgcgccaattgctcttcaatcgttacattgtaatcaccaagaacttccttgagctgactattttcactaaactctttaagggtagaaaatggtgccccacctaaggtgattaaacgctcactcatctcatccaaataaccatcaatttcttccatatattcatccatctttggatgccaaatcataaagccacgaccacgcatataccagtgaacttgatggaggattgaatgggctactgataaatcggccaccgcttgattcaaaacagccttagaatcagccagtgatggacgcgggctgaaagacgcaatttctgctggagattgataatatttttgtttcatcatatatcaccctttcttttatttataataattataaataaaagaagaaaaaattgcaagaattatccctcctcctctgaattattggcagacaaattccttgctatattaacttatatacgttagactagtaagtaagaatagtatgtgattttctttttagaaaatcatcgcccccatatgtgtatatcgaggagggattttatgtcagaagaaaaatttgacgcaaaactagaacagctatctggatctgcaaaagaggtaattggtaagctgaccggcgacaaggaaatcgaagttgaaggacttgttgagaaaggaattggcaaagcaaaagagctagtcgaagatgcaaaagatgggcttgaaggtgccattaacggcatcaaaaatgctttcgacaaagaagagaaataaacaaagagttcaatataggtaggattggtcgtgcactgtttgataatgaacattacacttaatttggtcttttacctatagcccgaacaaaaatatgcaagagaggggaactcagacatttacctgtcgagtctaccttctcttttcttatgtcacgaaaggagtatctatgaaaaaaatcgtttttgtctgtcttggaaatatttgtcgtagccctatggctgaatttgtcatgaaagacatgacaagtcaatttcacattgaaagccgtgctacttcaaactgggaacatggtaatcctatctaccctggaacacagaaaattttccaaaagcacaagatttcctatgaccaagataaatcatcacagcaaatgagccagacagatttcgaagcatttgatattatcatcggtatggacagcaataatgtccgagatttacagaaaatagcaccagcacatgcccaaaataagatttttcaattcgcagaaaaatccgtaccagacccttggtatactggagattttgacgaaacctacgaaatggtaaagaaaggttgtcaagactggttggacaggttacagtcatttgatcaagaataagattttctatgtaatatttttgtaatatttgtaaaaaaatggtaaactatttctgactgaactgataatttcttactgtatcctagaaagaactgattagcatcggtcaaatcctatgaaagagtaaaacgatgaaagagttcaaattacctagtataaaatggcatgatataacaagtcatttcacccgtccaaaacttgaaatcctctcccttattattatcctcatctgtgccctctctgtatttacagggcgaattgccagcaagcaagccatgactttcaataatggcgccctgcagtacaacggttatgtggtcgcaaataaaatgaatggtcaaggaaaattgacctttgataatggagatgtctacgaaggacaatttacaaatggaattttccacggtcaaggaacctacacatctgcaagtgggtgggtttataccgggcaatttaaaaacggctatgccgatggaaaaggaaaattgaccaccgaaggacaagctacctacgaaggaacttttaaacaggggatttatcaatatgaaaattaaatggttatccgttatacgtgtgattggattagtctttgtcctactctatcatttctttatcaaatatttcccaggtggctttgtgggggttgacctcttctttaccctgtctggatatttgacaaccgcccttttgattgatgagtttgcaaaacataaaaaaatagatattgtcagctttttcagaagaaggttctatcggattctcccccctctggttttaacgattcttttggttcttccacttgctctgcttgtccgcaatgatttcattgccaatatcggcaatcagatagtcgctgcgctcggattcatgacaaacttctttgaaattctatcaggtggtagttacgagaatcaattttcacctcatctatttgtgcatacttggacactagccatagaagttcagtattaccttgtctgggctggtttagtttggtatcggactcgcatctcaaaaagtgtggggcaactacgtggatcaatttttctaacatctataagcctcttctcgctaagttttttagcaatgtctatctcaagtttctttgtagataatttctcaaccatttactactcgagcttcacacataccttcccattcttcctcggaagcattctcgcaaccatcgctggtatcggaaatacaacaactgccttccagcaacaagtgaatacattgagtatcaaacaagctataggtctgtttcttggaggactaggagtagaacttcttcttctctttactcttcaattcagttccatctggacctatctaattggttttcttctatctagtttagctacagcaactatgatttttgctgctcgggtacttcacgagaaaaccgaagatgtcaaagaacctgcaattatcctcttctttgcaagtatttcttatggtatctacctcttccattggcccttgctcattatctttacacaactgacaaatgccactatcgctgcgggattatcctttgttttttctactatcctatcaactatttccttctatattctagaaccatatattgctggtaaagtaggaagcttgtttggattagcaatagacttaaaaccctataaaaaatggcttcttagcagctttgcttgcttgaccatagttggcttaggtatctgtctatttggaccaaaattaggaagttttgaacaagagagcatggttagcaatctttatcaagctcagacccaactaaatacaacacgatctgctgctgaaaacgctaaagctactagttttgaaattcaaaaaggagttatcatctttggcgattctgttactgttcgcgctagttctgccatacagaccgcgctaccagatgcacagatcgatggaactgtcagtcgaaatctctctgaaattgctaaattgataaatctttataagcaaaataatagcttgaaagagactgtagttgtagcgctaggtacaaatactacggataattatcaggaactactagaccaactagtcaaagattttcctaaaggacgtcgccttatttttgtcactccttacgatggaaacttcactccgagcgaatccatttcttatcaaactggtcaatacgagaaagaattggctgaaaaatatgattatatttccattgcagactggtatcaagttgcaaaggataatccaccaatttggtacaataccgaccttgttcatttcaatcttgaaagcaatggaggcgaagtcttcgcccaaacgataaaaaatgctgttgaagccgttgctgatggtccaatcaaaaactagatttatacatcatcatcctctgagaatttctcggaggatttttgcacgattttccgataagtccagtgcgaactctaagaaatggcgctgtgcctgagctcagtctcaataaatcttgtgaaataagccacttctacaaaggacggaaaagcgaagtaacgataatagaaagatgacaagttaaaaaaactcctaccttttacagtaggagttggtgtcaaattgactatttttgcttactttggaaacgccattcaaagcgtttctgatcgtaaaatggatacatcatttgtaaaagagtgacggcaagtagccaaccaccgataatatctgtcgggtagtgaaccccaatatagatacgggatacagctaccaggacagcaagtagaatcaacatggcttgtagcacaagtctagctatgcctttcttcatcctctggtgaacaataataacaactgctcctccaatcatcatagttgatgcagtatgccagctaggaaatgaataaccgatggtatcaatcaaccattcaatacttggacgcggacgttggtagacatatttcagggctgtggatgccacacccatcgccgcaaaactagcaagtaggaaataagcttctatcttccattttttatagtagtaaaagatagcagctagaatcatggtaatagctaaaataataacagtatttcctaaaacagtaatagaggtccaaaattgactggctccacttggtaaatttccacgaatggcagactggacagtcgaatcaaaacctgctagggtactaggataaaattttactacatagcccaatgtcacaaaggccagagcaaaaaaagatgcgtttcgtaaatggatttgtttattcttcatacagtatagtttaccttataaaggttaaactttctttaaaataggttgggctgctttgtaacagatataaaatattgccgaaagcacaatcccttgtaaaagattaaaaggaagtaccatcataaaaagatagttagtcagacccaagatttctttaatatcaaaatttgcaaaagcagcataaacaggcaccgcataaacgtaatttaatgccagcatcactgctgtcgaaccaattgtcgcaacagcggctgcttttaaataattttttaacgtttgttcatttttccagaaataagctactgctaaaatgaaaactgacatagctgcaatattcatcggtaagccaataattgtcgatggtccctgattatttaaaatcagtttgagaaaagttcgtaccaaaaggatagcaaaactagacttcatatctagaataagcagaccaaataaaatcggtacgagagaaaaatccacttccaggaaactggctgttggaatcagtggaaatttcaaatacatgagcagaaaggatactgctgagagaatggcgataatcgtcattttgcgtgtgtttgtcataaggttcctccaattttgaaaattgaagaagcgtggaagagcaggcaaaaggcctccacttcgtcttctcccatccagactttactgtcggttgtggaattgcaccacatcagctttcgctcgcagactaccaacggtctattttgttctaaaactgcgttagctcatctcgacatacattcagtatggtcttcgattcgctgcctagtcgtaaaacaaattaccacgttttacactgccggtcgggaatttcaccctgccctgaagactatttcatcataccaaaaaagccttgcatttgcaagagcttggtaagttttcactattttaacttgtccccatcataggtgtgaaccaaatctagaccagcgaactgttgctgccgaagagcctcatatacaatcatacacgctgtattagagacattaagactacgcacatgttcatcattcattggaatacggatagccttctctggatgttcacgcataaaatcttctggcaagcccttatcttcacgaccaaataagaaataatgaatgttcccatcattatagtcttcatccgaataggttttatcagcaaatttagatactaagtgaacacgtccttgtttgctggcataatccatgaattctgctaaattgtcatagaagcgaacatctaacttatcccaataatctagtcctgcacgtttcatcttacggtcatcaattggaaatcccataggcttaatgatatggagaggactattggttgcagcacaagttcgagcaatattgcctgtattctgtggaatctgtggttcaaataagacaatgtggtttttggctgtttcttctatatactctaatgtttcaatattcataagaacctctctggtgacatttcactaaacacgaatacccttcgaaaatcaaatccaaaccattgtcagcttcattttgccgtataccagtacggtctgttgcttgttgtctagtttctttttttgattttcattgagtaaaaagactcgactgtctcctatggcaagaaagacaaaaaaatagccacactgcccggagtcaagctcagcaaacagcatggtgaatgatgattcattcacttaactcacaacaggtttgagttaaatcaatgaaatcgtgatactattgtagcttaaagaaggctgaaaatcaagagttttgccccatttttttcaaattttcatagaaaatcatggaggctgggcagaaagaccaaccttgcttctcagagttcgtgtcaacatctgagcgcagtgattgattggcttttacagtccagtggactgttaatattgaggcgaacttgcttcgccctatctccagccttaaaaggctcccaaatcttttgagagagtactaaaggcaacctaaaaacctatatttatacagaacaaaaagtaggttgccctacttctgcttatttcttttcaaactaaacctgtccggcacaggatcttctccaccttccaccaagggatgacagcgaccaattcgagccaaccccatcaaaaagcctttgagtccatgtttttgtaaggcctcgatcatataagccgaacaagttggacggtagcgacaagagggcggaaaaaggggagaaataaatttctgatagaatcggaccaagccgatcaaaagtctagtcattattttttaactggcttagtaacggccagggtatgtagtttactgatgtctttcttattgagcttgcggtattctcctggacgtaggccggtcaagtcaagattaccaaagcgagtacgagacagcttgtctacctgcaagccgacagcctcaaacatcttcttaacctggtggtttcgaccttcatggattgttaattctacaactgagcggttcttaacagggtccacctttataatctcatacaccgcaggcttagtctttttgccatcaatgacaacaccacgggtcaagggacgcaaaacttccttgttggcaacccctttgacacgcgccaagtaaaccttatcaatctcattacgtgggtgaatcatttcgtctgtaaaatcaccgtcattggtcaaaatcaagaccccagatgtatcccagtccagacgtccaactggataaatccgttccttaactgttggcaacaagtccacaactgtctttcttcccttgtcgtctgacacactagaaataacacctcgtggtttattgaggagatagtagaccttctcttcgttataaattggttgtccctcaacctctaccttatcacccgatttgataactgtccctagctcacgaacaacctgaccatttacagtaactagtccttgtttgattagttcttctgccttacgacgactggcaactccagcatgggcaatgtatttattaattctcattttctaactcatttctttctacgaatagctctgtttcctcttgaatcaaatctatttcagacacatcaggcaattcttctagactattaattcccatgtaatccaggaaataatccgttgtcacatagagatttggtctaccaagaacctctttcttaccgttctcacgaatgaggtcaaaggcctgtaatttactgatggcaccactggaattgactccgcgaatatcatcaacttcaatccgagtaatgggttgcttataggctacgattgataaggtttccaaaagagcccgtgacatagtctgattgattggtgttttggcatagattcgcaaaaggtttgcatattcttttttagtaaccaacttgtagcgattggaagactccaagatggctaagcctgaggctttgtctgccatatatttctcactaagtttctctaactgctggctgacagctgtcggctgcatttccaacatctctgccaaatttcgtaacgtcaagccatcctcacctgccacaaagagcaggacttcgatttcagctaagcgattcatcttcactccttactagataaatatctccaaaagtctctgtctgctccaggacgatttcatgaaccttgaccaattccaaagtcgcaaggaagatcgtaatcatttcattgacatcttgactttcttgaaaaagctgacggagttcaaggcgtggaccagtctcgaaacgactgcgaacaaagtccatcatgtcttcgattttatattcatcacgggcaatggtcgcatgagactgacggaggcttgcctgtttttcagccattactttagaaaaagctaggaaaatgtcaatgacggtcttatccttggctaactgtacatcatcataaatcaaatctaatttgggttttgaaaaatagttggcccgttcatcatgttgctcccctaatttctcactgagaagtttgaacttgcggtattcttccaactggtccaagaggtccatttcaggatcatcttcgggatcaatttgctcaacaaccttcggcaataaccgacgacttttgatgaccatcaattgactagccatgagcatatattctcccgctacctctaaacgcatggcttgcaaggtagcaatgtaggccaaatattgctcaataacctctgtaatcggaacctcgtaaatatctacttgatacttggacaccaggtgtagcaggagatcaagtggcccttcaaaatcttttaattttatatccattatctaaatttttccaaactcatgcttgttttcagtcccaactgcttggcgatttggtccaaggattttccttcgtctatctgttttagaatatactgctctcgcaatttttgggctgtccaatcaggcttgccgatggactggacaaattctgtcagacgattaaaaaaccattgacgagaataggtctgtcccttcttatcgaagacatagcgtccagacagatgagactccatatagggtatcaattccttgggcagagtgagcacccgcttggctcctcccttctcaactgtcaggacttgaaaatccagattgacctgctgactagtcagctctgctatttcacttggcgtcaaacctaaatatgctatcaaaagtgcgatgagctgaccttctagccaaggactttcttgaaagaggagagttaaatcctcacgctccagtttctttttgacgctggctggacctgacgtcgtttgcaatttataaaaacgatccaggagattattttcataaagaaagtagagaaattgattgaccgctgacatttttcttttctgagcagcaggtttcaagtctagaagagactgctgatagaccaaaagagactgttggctaatctccccctttgttactgtcacaaactgctgcaggtcataggtataggacttttggctgttgacactgacctttttgctctggataaaagattcaatcgcctgcttcatttcttgccttcttttgatgctagggggaaattatgcaagagagcattgattgcctttaagatggattttcgtgtaatgattcccataaattctctattttccccaaggacgggtaagaaagattgatctactagcttacgcatcacctctgtcaaatcataatccagaccaaccgtctcttcatctgtctttacaatcacagaaatatctctgtttaactcatcatccgatagttcattttcagcttgatatttaatgatttccgtcaagccgatggttccaaaaaagcggccatcttctgttaccacaggtacgcgtgaataggtcatgtgactgagtaacagttttgcatggtcaatattatgcgtatcaataattactgccaatttatccgctggtgtcaagaaagtttcttcctggtccaataaaaaggcttcaaattctcttgcaatcatcttgaaatatcctttgtcaatgctgggtaaagttggtgctgtcgattgtagtaatccacatggaagtgatcatcatagatggtcacaagagcatagagacattctctgaccaaaccacgaggttgactaacggagccaggattgaggaagagggtcttgccacgcacttcggcatcaggcacatgcagatgcccatacaaacaaatatccgcatcaacttcctgggcccaataatccaaccgctgccagccgtaattaatgccataaagatgaccatgagtctgagcgatagtcacaccatccaattgagtaatgagctggtcagggtaaccaccaaaatagtcgcagttcccattgaccacttgaatgccgtcccacaaactatcttgactatccagctccgaatcaccattgtgaaagatggcatcgaccttgctaagataatgatgtttaatatcctctacaatctgtctatccccatgagagtcgctcatgactaggattgttttgcttgctcctgccatactggaaatgcctccactaatttttctagtgcttgtgcacggtgggaaatcttatttttttcttctagggttaattctgccgaggtcttacctgtttcgcctacgaggaaaagtggatcatatccaaatccattttccccacggaggtccataccgataaagccttcccagtccgcttcgacaaccaaactatcacgatttggagcagccatgaccagagtacaatggaattgtgccgaacgatctttcagttcaaataccatggccaattcgtgcaagagcttggcattattgagctcatctgtggcatctggacctgaaaaacgggcagaccaaactcctggcaggccacctaaagcatcaaccttcaaaccagaatcatctgccaagaccatcttgcctgtcagctctgctatggtttcagccttgagccgtgcattttcctcaaaagtcatacctgtttctgctacatctggcaggtcaggatagttgttgaggttctcgacctggtagccaaaacgctcaaaaaacttacggaattccttagtcttaccttcattttttgtggcaatcaagatggtatctcccacgcttgccaatcccttgtcttgaccgaagaaatctgccgtgctaacccctgcttgtggcagatgaaccaagagaagtttgtcattctcagttaccagaatagctccttggtgttggagggccttgaactgacgattgtttaactcattcaaagtatcacaggcaaattgaaagagggcaaattcagactgaagtttgatcacttcaatgttgacacactggttaaagttctcatcttcataattaccagcaattagtttgtcaaacaattgaccaatctggtaaatttcctgctctctgccattttcaccaaatgaaccaaatagattggcaaagctggcttttccaataaaccaattgtgttcatctctgtattcgtatatcttgtctgtcatagttctacatgctccacatgaatatcaatgcccatccagctttcagctatttctttaaaagctgccggactagctgttgtgtaaaatctgtgctgaatatccttttcggtacggctgcggttgatttgaaaataatttaataaaacagaaatatctcgcgcacattctgccccactgtcaatcaacttgacatccttgcccatggcattctggatgatagggcgaagcagaggataatgggtacatcccaagaccaaggtatctacttgcccaacaagtggtcgaagtgtctcataaacaacctttttggccaaactggattggtggctattggactcaaccagtggtgcaaatttgggacaggctaggctgtctacctgcgtttctggagaaagggcctgaattttttcacgatagatatcggattgaatggtcatagccgttcctaagacaccaaccttaccagtttgcgttgccttaatagctgccgaagcacctggtaaaataacacccaaaacaggaatatccaacttttccttgacttcttcccagactaccgctgttgccgtattgcaggcaaagacaatcatttttacattttttgtcaaaaggaaattgaccaactgccaagtatattctctgatttgttctgctggacggggtccataaggtgcccgtgccgaatctccgatataaacgatttcttcatggggtagttggcgcattaactcacgcgcaaccgttaatcccccaacacctgaatctaaaaaacctattggtcgattatccataatactgagaatagccagaaaatctgactagcctttcttttctactcaaaaaatgggatctgggaatgaatatcccagtcccagtttgattattttttcttgcttgccactttttgttggctcttgatttggcgaagtacttgttgtacttttgcctcgcttggtttttgccccatttggctcatcatcaaacgcaaagcattctcatccaaaattggtttatcagcaatgtagttttctacctgtctgcgtgacaagtaaatacccaaggccacaccacctgcaaatgccaatacaataagtaaaatagctaaacctaagttcatctgtcaatctcctgactcttctaaaaagtatacttctgattgtttttaacaatctttcaataaccctattataccaaattccctagtcttttccaagacttacctgtcaaaatcaaaaccgtaaatagttgcgaaatagtcttctggtgtttcagcacgacgaatcatccgcgctgtgccatcttcctgcaaaaggatttcagaagaacgcagacgaccgttgtagttgtagcccatggagaagccgtgggccccactgtcatgaatgaccaaggtgtctcctacttctacccgtggtaattcacgattgaccgcaaacttgtcgttgttttcacaaagggaaccagccacatccaccacttcgattggcgcatctgggcgcgtgatattggtgatatggtggtaggcgccatagaaggcaggacgcatgaggttggctgccgatgcatcgacaccaatataagtccgataggtttccttacgatggagcacctttgtaatcaagtgaccgtgtggcgccaacataaagcgacccaattctgtaaagattttaacatgtcccataccagctggtgtgagaatttcctcgtaaaccttacgaactccctcaccaatgacagcaatgtcgtttggttcttgctcaggacggtagttgactccaatcccacctgataggttgatgaagtccaaggtcacacctgtttcctcacgaatttccaaggccaattcaaagagttgacgagctaagacagggtagtagtcatttgttactgtattcgaagctagaaaggcatgaataccaaactgcttcacacctagttcttttaattccttgtagcccttcatgagctggtccttggtcatgccaaacttagactcttctgggtggtccataatatccgttcccagcgagaagaccccacctggattgtaacggaggcagaccgtttctgggataccagcaacatttttcaaaaactcaatatgctcataggcatcaaggttaatggtcgccccaacttttctggcataaacaaactcttgcgcttgggtgtcattagatgtgaacatgatgtctttaaagcccaatttttcactcatcagcacttctacatccgttgcacagtccactccacaaccttcttcttgcaagatttttaaaattgctggtgtcggtgtcgctttgaccgcaaaatattctttaaagcctttgttccatgaaaaagctgcattaagggcacgggccttctcacgaatgcctttttcatcatacaaatgaaaaggagtcggaaattgctccgtaatgttttctaaaacttctttactaacaaatggtgtcttggtcatgtcactacctcatcaaatatttttcctattatatcacaaatatgtgaggaactgtagctttcaactccaccaaatacttgcaaaataaattatgagcgctataatgtgattatcattaaaaaaggagtaatatatgtcaacattagattttgattttacagaacgcttatatgccaactatctagctaatccaagcctacaggcaaccgaaaatgccgttagccacaacggacttttgaaatccttagaaacacgccaaagcgccatcgacaatgactatgtcttttcaatcgacttgaccaaggacgctgtttcaaaccaaaaggcttctggacgttgctggatgtttgctgcattaaacaccttccgccataaactcatctctgacttcaaactggaaaattttgagctatcacaggcccataccttcttttgggataaatatgaaaagtccaactggttcctcgaacaaatcattgctacagctgaccaagaaattggtagccgtaaggtaaaattcttattggatacccctcaacaagatggcggtcaatgggatatggttgtggccttatttgaaaaatatggtgtggtaccaaaatccgtctatccagaatctatctcatccagtgccagccgtgagctcaatcagtaccttaacaaattgctccgtcaagatgcacaaatcttgcgagacctccttgcaaaaggagcttctccggaagaggttcaaacacaaaaagaaaacttgcttcaagaaatctttaacttcctagccgtcaaccttggcctccctccacgtagctttgattttgcatatagagataaagacaatgtctatcaccgcgatacaaatgtgacacctcaggcattctacgagaaatacgttggtttgaaactatctgactatgtctccattatcaatgctcctacaactgacaaaccctacaataaatcttatacagtcgaattattggggaacgtcgttggtgcccctgctgtccgctacctcaatgtagaaatgaaccgttttaaagaactagctattgcccaactcaaagctggtgagtccgtttggtttggttccgatgtcggtcaaagcagcaatcgccaaacaggtatcatggcaaccaacacctacgacttctcttcaggtctgggtatccatttccatcaagacaaggctggaagattagactactccgaaagcttgatgacccacgccatggtcttaactggtgttgatttagatgacaatgagcaacctctcaaatggaaagtagaaaactcttggggtgacaaggttggtgacaagggatacttcgtcgcatcagatagctggatggacgagtacacttatcagattgttgtccgaaaagaattcctcacacaagaagaactagcagcttatcaagctcaaccacaagtccttgccccatgggatccaatgggagctctagcataacaaacgacatataaaaaagaggtaaatcctcttttttatatgtcataattagtctctactcaaaccaccaaagatacggagtaggttgaggaagaggttgatgaagtcaagatagagctgaagcgccatggatacgacccacccttggccaacattaccaccagtttgttcgaaaacattgcggatacgttggttgtcataagcaatcaaacctgagaataccaaaacagaaatgatagacatcataaagcttagaccagagctacgaaggaagatattaataacacttgcaataataattccccatagagctgcacgcaatgcctgagccataccagaaagatccttcttcgttgtcatcccaattacagccatgatagcaaacataagagccgctgacacaaaggcaagcacaactgtttcactagtatagaacatcaaaatcatgctaatggtgataccatttgttactgagtaggcaagaaacattggtagagccattgggctatttttagctgccattgctgaagcagaaacaaccaaggcaatctgaccaatcataatcagcatcatgatgatggaacctgcactcagcagactaagcaataaagattgaaagacggtcacagccaagaaagaaactagagctgacagaccaattcccatggcaaccacaccataaattttaccgaagaaacggttgagggcggtattatccacctgattaataataaatgaatcgttattcatactattctcctttaaatcatcttattgaaaccgaaagaccttacgatttttccacttgtgttgtaagggcagactccactctctcacagcccaatacttatccacgcatgtcacaatccaggattccttgtagcaaggaggagcgattgtcgcaccaaacatatgcttcacaatgatgtcttcttctagtttattgagttgaatgagtttctgagcattgcgtttagcaattcgtggatgaacccaagcatggctcttgttgaatttggtatctctccagtcatagaagaataaatcatgcaatagaccaccacgagctgttgacttggcatcccaaccaaattttttcgcaatcttataacttgtataagagacattgatggaatgttccaagcgcgtggagtgataatgatgaggaattttccccaatttttgcaccttgggtgtggcaatcaagtgccccacgtaatgcatgtattctttatcttgtttatatgcaaccattcgttaacctcgttggaatattataccacactatagtacaattggcttaaataaagctaaacaatagaatacccgccgcaattgctacattgaggctttccgcctgccctggcatggtgatatgaacaagttgatccgcctcatcagccactaaatcagaaattccctgaccttcgtttcccatgaccaaggcaaaactagaatgtggcgtaatttccttatagtcaaccgactgactagagagggtcgttgccaatatttgtatctgattgcttttaagagctgtaagaatggaggaaattggcatccgataaactggcaaatggaagtgactcccctgcatggaacgaagcactttcatattataaatatcagccgacttatccgatagaaatactccatcaaaaccagctgcatcagctgtacgaatcattgtcccaacatttccagggtcctgcacatcttcaagaaccaaaaattttccatccaaagtctcaggtaaacgttggctcggcaaagcaagttgagctactaccccctgaggcgtcttagaatcagctaattcttgcataatttcaggactgacaactgtcacattggctaaacctgcaaccttttcaaaatactcttccaccacaaaaatatgctcaatattggctccagcctccatcgcttcctccagcaaatgccagccttcaatcaaataagaagaagtacggtattttttctgttgtaatttcttaacctgcttgaccaaatgattggcctttgagcgaatgatctccatgaatgccccttttcttttactgctcagcaacttcaattttccaacggctaaatcaattatcttgatttttgaacagtcttacccaaccatgatataataaagtaaatgtcttgtcaaaaggagaaacttatgcgaaaggtaaaaatgattgcatctggtcgtgtgcaaggagtcggctttcgttggtctgttcaatttttagctgtggaaataggcgacatctacggcagagtttggaataatgatgatgggactgtcaccattttagctcagtcagataatgctgagaagctcagccattttatccatgaaattcggaaagggccttctcgtatggccaaagtcatctatctagatgtcaccctagccaattttgaggactataaggattttcaggttagctatagataaaacttgtatatttccgtcaaaaaaagtaaaatagagagtatactgaaaaaaacaaaggaacgaaaaaaattgaaaaataaacgtctactcatcttgtcaggcatggccttatcaactcttcttttcttatctggttgtgttcaaactgataaaagcggaaatcctacaggtcccatttgggattggttgggacaaccaatgtccaacttgattcgcttttttgcagaagatcaagctctaggatttggtcttgctattatcatcgtcaccttattggttcgattcatcatcctcccattgggaatttaccaatcttggaaagctgctatccaatctgagaagatgaattatctcaaaccgattttaggcccaatccaggagcgcatgaaaaatgcaagctctcaagaagagcaacttgctgcgcaacaagagtattttgcaactcaaaaacaatacggtgtgagcatgctcggcggaatcggttgtttgccgatgctgattcaaatgccattcttctctgcaatctactttgcggctcgccacacaccaggaatttcagaagctactttccttggtattaatttaggttcaactagcctgattttgacagtcgttgctggtattttatactatgcccaatcgctcttaatgcaagtcggcatggatgaagaacagaaaaaacaaatgaaaaccatggctctgatgaatccaattatgatcatgatgttctcatttgggtctcctgctggagtgactctctactgggttgtcggtggtctcttcggtattcttcaacaagctattacaaacttcattttgaaacctcgtattcgtaaacaagtggaagaggaattcaaaaatatcacagtgtcagcaactcctcgtaaaacgaaggacgttactccaactgcttcagcagttattgaagaaaagacatctaacaagaagagaaaccgtaacgccggtaaacaacgttctagataaaaaatcgcaaccatctatttcagatggttgttttcttatatagacactatgtaaagatccccagttgagaattcgtggatttacctgtacactagaataaaaaaataatcaacttctaacaggaattaccacactcaattagaggtctttacatattgtctatacaaaaagagagaatctttcgactctctccacaccttatttcgttttttcaaccttcaagatttttacatcatagctaccagcaggtgtttcaattgttgcaacatctcctgtttttttaccaatcaaagcatggccaattgggctttcgtttgaaatcttgtttgcaaagacatctgcacctgcagcaccaacgatatgatagacttcttcctcggtctcaccaacttcttgaacagtcacagtcttaccaattgctacttcatccgcagcaactgcatcactgtttacgatttcagcatagcgaatttttgtttcgattgttgagatttgaccttcaacaaaagcctgttcatctttagctgcttcgtactcagagttttctgaaaggtctccgtaagaacgagcaattttaatacgttcaacaatttctggtcgacgaactagctttagttcctctagttctttttctaatttttccttttcttccaaggtcattggatatgttttttctgccatttgtctttccttttcttttatttttcatgaaaacaaaattatgtggaaaaccacataattttgttttaagaatttactcattattaagatgtgcatttacatacttagcaacgttttggttatgttcatcaatattatttgtaaagtaaacatttccagttgtaacatctgctacaaagtaaagatagtctgttgtgttggcattaatcactgcctcgatagccgaaaggcttggactatccactggtccaggcatcaatcctggggtccaataaatgttgtatggtgactcaattgatgtatcaatcgctgcatcttctgctagagttgtttcttgaccaagtttaccctgagcatacaagattgcaatattagattgtagaggcattgctgcattcaagcggttaaagaagacacttgcaatgtttcgacgatcttcatcagtagaaccttctttttcaaccaaagatgccaaggtaagaacttcatttacagtcaaattcttagcagtaatcgtttcataatatggttgtaaacgattatccatcgcggcaatcatttgctcaacgagctcttcgatagttgtttcatcgctgtattcataaaccgctgggaagaggtaaccttccaactgataaataactccactatcagcagctggtaagctggcaaacaattttggataagtagcaaccattcgattaataaaatcttggttggtcacagtagccataaactgttctgcagtaaatggtgttttatcgttcttatcttttgtattagtattgtctgtaatagcctgagcaatttgtgttaatgtatacccttcaacaatcaaaaccttccctgcagcttctttttgagctgtcggagttccgctttcttgaagtgctttggcgatgtcatccacagacatattttgttttaaattataaaaaccactttggaaattattataactcttaattttagagtagtaattaaaaatagtagcattcttaatcaacttgttgtcaactaaaattttaccaatttctaaagttgaagatccttctggaatctctacctgaatagtttctgtagcttttgcattaactggttccagactagattttacccacatatagccagtaacacctgtcactaggactgccactacaacaatcgacatgataacagagacaatgtgtttagcggcattatcttgttttttacgacgttgcttgcttgttctgtgggttgttcttcttctgggttgtgtttcctgcatctgcttgtctacttctggaacaatagccgttgtctttggagcaataatagtttcctctagtgcgatgatttctgtatcacccgttacagctgatacatcttccgttggaaattccaaaaatgtatcttccaaagaagacttctctgaaaggacagactctactggctcagaaactgacgagcttgatggtacttcatcaaatcctgccgtattagcagccacaagattccttaatttctccaagtttcgttcaacagtatcttgtggaactggacttgaaacaacttctttttcaatcacaaaagtctctggagtagccaaagtttctgatgttggctcttcaatactttccgtcatcacttctgattcttgctgttcttctgacaagtatgaatcagggaaagcaataccttctacttttacaatttcagtctctctatggggggctttttcttcggcaagactaggctggagctcattgataacttcattacgcttatcaacaagaacatccgctgactgttccgccaaacgtttcaccttcaattcttccaaatctcgtaaaatttgatcgcggaagcctgaagactgcgtgtttttttcattcgtatcctttgtcacgctgttactcctttcacacagttactatacattatatcttaaaggcttatgaattgcaagaacttccctttctacaaggctttccagtacatatcactccacctttgtcctccaaattgcgacaaggaggggccaaaatcttcaaactggttcatttcatagtagctaatcaaatacctcttacaggtcagggaaactccttcaaatcctcccgctaaagccacttcttttatggctgccaacaaaagagttcccactccctgtcccttataggcatccgctacggatagactggcaatagctaggtgaccgcctgtcggcatgtcactctctgtcaagtaaaaaatatcgtctgtaacagtctgcgaaacagagggacaggataataaatatcctgctatttcctcatcgtgttccattattaaacaggttttactcaaagtattcagataagtagcaagaacagactcagctatccgttcctctttagaaaaattggcattttcaatcaaaacaacctgttctaaatccgaaggagtagcaaaacgaatttccataattttctcccttatatagcggaaaaacaggggccataggcctccgtctttctttttattggacgttatttgtaagatttgacaagagtctttcgaaggaatattcataggactgaatatcaccagctcccataaatacatatacggcattgtcatggtctaaaagtggtgaagtgttttcaactgtaacaagtccaccttttttgttgattttagccgccaaatcttctaccttaacctgaccattgtctgtttcacgcgctgatccataaatttgagcaaggtaaactgcatctgctccattcaaagcatctgcaaactcatcgagaagcgcaatggtacgagtgaatgtatgtggttggaagatggctaccaactccttgctaggatacttctgacgtgccgcatcaatggttgcaatgatttccgttggatggtgagcaaagtcatcaatgataacagtatcattgacaattttctccgtaaagcgacgtttgacacctccaaatgtcttcaagtgttctgcaaccagttgcaaatcaaatccagcaatatagagattggcaataacagctgttgcattcatcacattatgcttaccaaaggttggaatttggaattctcccaactcttcttcaccatggcgaactttgaattgtgaaccacttgtagaaggcttcaagtcataggcaacaaaatcattattgtcttccaagccataatagtagattggagcatttgccgtgatacgacgaagttgctcatcttcaccaaaaacgaagagagcattttttacttgcttcgcataatcattgaaagcattgaaaacatcctctagactagtgaaataatctggatggtcaaaatcaatattggtaatgatgctgtattcaggatggtatggggcaaagtgacgttcgtattcatcggattcgaacacaaaatactgagcatttgccgaaccgcgaccagtaccatcaccaatcaagaaggaagtatctgtgatattgcgcataacatgtgccaataatcccgttgtagaggtcttaccatgggcaccagcaacaccgaggctcgtaaaacctttcataaattcacctaaaaattcatggtaacgtttgtaggtatagccctgggcatcagcataagcgatttccacattgttatctggacgaaaagcattaccagcaatcaattcaacatctgctgtaatatttttctcatcaaacggtaaaatctgaatcccagcttgttcaagcccgcgttgtgtaaagtagtatttctctacatcactaccttgaaccttatgccccatttgatgcaacataagagcaagtgcgctcatacccgatcccttaattccgataaaatgataggtttttgtcatgttattcctcttctatatgtgtcaaattcaattcttgtgccacttggcgatctcgttgttgtctgcgctcaggataattgtaaacctgactctttcttaaaaagtcatacgaatttttctttataacctgctcctgttctctatcttctttcttcaaagaatagacagctggcatatcagcgagaatatagtctgtctgacgtaggttgtccgccaaacgtgtcaaccgacctgccttagattcagctgttgaaacgacaggaggtttcaccacaactttagctggtgctggtttttcatctcttaagtaggttgctgatcgttttttcttcaagtcttctctagcctgttcacgagccaactgcccctgtgttttcactggagaaggcttcgttttagtcagttgctgaaggcgttccttgcgagaataatggcttggcttagcttcaaacagaggaggcaggagctcatcttccgtttgtgctactggttttgccgacgcaactcgctgtgaatcggtagaccagctaaattccttttcttgataaggtcccctgatattgctaatcaggtcgctctcatcatataaactcataattggattttctccaactagtacctcatcatctgcgactagtggaaatcttttttcatgtctaatcataagtcatcctttcgaacccttattataccatacttaggccttatttcctaattctacgctgagtcaactgattccatatcactcaatccctaaaatctcacgaatatcctcaaccgtcaaattcgctcggctttcattgccatcaagaactgttttaacaaggttctttttattttcttgtaattcttgaatcttctcttcgattgtccctctagtaatcaggcgatagcattcaaccttttcagtctgccccatgcgatgagctcgactgatagcctgagcttccacggcaggattccaccaaaggtcgactaggatgactgtgtctgcccctgtcaaattcaagccaacgccacctgctttcaaggaaatgagaaaggcatctcgacttcctgcattgaaggcctgtgtcatttcttggcgttggttagcaggggttgaaccagtcagagtataggaagtcatcccaatttctatcagctgttcttctattttttccagcatatttctgaattgggaaaatatcaagaccctgtgttcaccttcttttagttgcaagagtaattctttcaaactattaagtttgccactctcaccactaaactcttccatgaaaaggctgggagtatcgcagatttgacgtaagcgagtaattcctgataggatttctatcttgctacgattgatttgagcatcatctgcgccagctatttgagtccgcatttgttgaagctgggctaggtagatagctttttgttcatctgtcagttcattaagtacattgacctctatcaaatcaggcaattcctgaagaacgtcttccttatgacgtctgagaacgaagggttgaatggtccgcgcaatgtccttggctgctaatttaccgaagtcttgtttgcctggcaataaacctggtaagacaatttggaaaatggaccatagttccgtcaaatggttttcaatcggcgtacctgagagggcaaagcaattcccaacctcaaactcacgcagaagctgtgcaatcttagattgggcattcttcatgacctgcgcctcatctaaaatgaggtagtcaaagcgttcctgtctatagagtgcaacatcctgtctgaaggatggataggaggtaactaagacttggtgatcattggcaatgatctcttcacgctgttccttgtttccatggacaacagccacatctaaacttggagcaaaccgcttacactcatctaaccagttataaatcaagctagacggtgccaatattaaaactttggaatcttttgtcatccgactggacagaaaggcgatagtttgcaaggtctttccaagccccatgtcgtcagctaaaattccgccaaaaccatacgtatccagcatagtcaaccacttaagccctgtctgctgataatccctaagcgacgttgttacttccacagcaggaagcgggaacaaatctggctgagctagatagcttgccatttcctcaaattccttggagaaactgacttggttgaattgtgacaaggattgagccaattggtaaccggcaagagcatggacttgtacctgcccctccttaccatgacgggcccgcaaatagattagggtttgactgattttcttggtttcctcatcaaaaacaaataccttaccgctcgggctagtatagtgatcctcttgattcaacaaggctgtaatcgcctgatcgatttcagattgttcaatacctgataagtcaaacgaaatatccaaaagtgagccgttacgcacaatttctaattgaggtttggcttcaatatataaagcctgtagcctttctgctagatgaacctgccccattttttgtaatataggcaattgttgttggaaaaatggatagagctcctgctgactaagagccgctctctgggcatgatatgtccccctaaagccagctaaacgaatagcctgatagaccctctccaaatgttggaaatggctggcaaaaggcaggagagccaaatcctcttcactccttaccttacgtccatcaaaatccaaaaccaattggagtgataaactgtcatttgcctccatctgaatatgaaattctggcttgaaatcatgaatgatgaagcgtttaggtgccttaacagtcccaattgtctgcaaatccagcaagcttaaagccagacgattttggtcagggaaatctacctgcacttttctcaaacctgattcggttggaacaagttcggaaatttggtaaatcagatgttcttgatggcgattgacactataaaccgtgccatttactaagagatagcgcccatgaaaaagtggtcggactgttttttcgtgaataaccatttcaatcatctgcgtgtgaacggtcacctcaaaatgatagagcccttcctcacctgtcaacggaagaaccatcaaggaggaataggactgctgttgataggaaaagttaaaatgttctagctgatttaacagctccaacccctcctcaaaataggcttgtggcagacgaaaatgtcgtccaaaatgagtaagaatatccgaatctataccaactttctctggtaccaaggcccagagaaaatccaggagagcctgacttggttcatcaaaattttcataagtaacttgctcataataatttttacctatctgatagtgaccgttggctttcacaatgcgcaaaaaagctccgatgtcccgcacaatgtacgaacgtgtatctggcaagcgggtaattttcaaggtccaatctatctgacgatcatagggcaataagctcccttcaactgataactgatacttaatccccagttcaggttctggccgcaaaatttcatctaaaaagagaccgccaaaataagtccgacggacggtttccttatgttgttcaccatcttctttcaaagactgcttcatatccttgcctgaggcatcattttttaaaaaatactccgtggcagctagatgttgacagtaacctttactttgaaataactggcaactacactgtaaatcgctatctgcatcgccgtaagtaaagcgctcaccagcaatatccagcaccatctttccattctcactatgaagaacagtcagttttccagcctcgtacaaatcaattccttcttggcgaatccgccctggcatcatgcgacccattctaactcctttatccttcaaccaatcatcagctcttctgtaaaatatatctaaaatattatcttttcattatagcatattttcaatttgaattgtttaaataggtatcaaaaaacaccagcaggtaaactggtgtctctaatgaatagctaaataataaatcgttgcttgccacattttcaagattgtttttccgaatttccaaagccaaaatagggcaaatagcaggaaaacaactgccactactacgttaatcaagccttttccaaccaagaaaaacttgaaaaagaagacagtcacacaagtaagcaaggcaaggagtaaaacatgaatcagaactcccaaccagcccagccaatagcgaattccaaagggagggtgtttcttttcatcgaagtctgctagaccagtcaaaaactcaactagcaactcacccaaaaattccatactagcctacctttcttacctgtcgataatatttggttcgtcgaatcatcatcttgatagccttaaaggaaagtaaggttagcatactagccacgaatagacaaaaaaggaatatcacaaccaatggctgtttatactgattatagaccataattgaaccaccagtaaaggcgataaaataggatgccaaagtcaccaaattgagccagatacaagccactagccccagccaataacgaaagccgaaaggtttatactgactgtcttcataaaatacaagaaaaaatgatgaaaaagaaagcaatatcaaaaaagaacgccaaatcggaaccgctaccataccaacacctccaagtccattctagcatatttacgaataggtgcaaagaaaaaagaggttgccctctttatttccgtttccgtgcaatcagatgaatcggtgtcccttcaaatacaaaggccttgcggatttgattttccaagaaacgcatataggagaagtgcatgagctcttcttcgttgacaaagaccacaaaggtcggtggtttggtcgcaacctgagtcgcatagaaaatcttgaggcgtttgcccttgtcggtcggtgttgggttgatggcaatggcgtccatgataacatcgttgagaacagccgacggaatacgggtattctggctctcactgatggccttaatcatctcaggcaacttatgcaagcgttgtttggtcaaggctgacacaaagataatcggtgcgtaagacaagtattggaactggtcacgaatatcgtcttcccactgcttcatggtatggttgtctttttcaagcgtatcccacttgttgactacgataatcattcccttaccagcttcatgggcaaagcctgcgatgcgtttgtcatactcacggataccttcttcggcattgataaccatcaatatgacatccgagcgttcaatggcacgcatggcacgcataacagagtatttctcggtattttcatagaccttaccagacttgcgcatccctgcggtatcaatcatggtaaattcttgaccttctgggtctgtaaagtgcgtatcaatagcatcacgagtcgttccagcaacaggcgacgcaatcacgcgctcttcacccaaaatagcgttaatcaaacttgatttaccaacgtttggacgaccaatcaagctgaacttgataatatctggattttcttctgcttcctgagctggtaggttttcaatgatagcgtccaagacatcccctgttccgataccgtgtacagaagatactggataaggatcgccaagaccgagtgaatagaaatcgtagatgtcattacgcatttcagggttatctactttattgacaaccaaaataactggtttgtttgtcttataaaggatacgcgatacatactcgtcagcatccgtcacaccttccttgcctgatacgacaaagacgataacatccgcttcatccatggcaatctcagcctgatgcttgatttgctccatgaaaggtgcatccacatcatcaataccacctgtatcaatcagggaaaacttacggttgagccactcaccagtagcataaatacggtcgcgggtcacaccttcaacgtcttctacaatagaaatgcgttcccccgcaatacggttaaatagtgttgatttaccaacgttgggacggccaacgatggcgatagttggtagagccatagctcctcctcttctagtttacaataatttattcttttctaagatagactttgtttctggttgttcagcctgaccaaactgggcaaccatacgctcagaccaggattctgtctgacgggcacctgcataggctgtctgaacttggtcgtaggcttggattacttccacgccttgctccacatattcttcctgaaagacaatggcttcgctttccaaacgtggtttaacaggatggttttgggctggtcgacccaaggcaatacagaaaatgggataggtataatctggcaagttgaacagctctgctattgccatggccttatggcgaatcataccgataaagaccccgccgtagcccagactttcagctgccaagagggcgttttgccctgctaggctcgcatcaacagaagaaatcaggagattctctgttcctttggcatcaaagtctgaaccatggagttgagccgccttgctggcacgattatggtcgcccacaaaaaccagaatagcctgagcctgtaaaatagctggctggggcaccaggtcatagagtgcctttttttcttctccgactgcaccacaatgatggaataagactggaaattcttccagctagatgcagctcgcccagctgatataatagcttgcaaatgttccacctcaatgggctcttccgtaaaacgacggacggaagtatgattcagcatcaaatcaatggtttcattcatcggcggttatttcctttcaaatgcaaatcgcgagccagatagcgaatccgctccataacccgttgggcctgccaggtctcatcaccagacttgccagatgcaaaatgccgttccaactcatcaaaggagaaattggaagtaaagaaggttggcagattttcctgcatgcggtattgaagaatgacctgtaaaacatcgtcgcgcacccacggactatgttgctccgctccgatatcatctagtaccaagacctgagccagcttgatttcatcaatccgctccttgacagagccatctttgatggcattttttatatcgacaacaaaggtcggataatgcagaatggtggtcgagaggtggcgattggttgataggcgatgggccatgtaagccatcaaaaaactcttcccaattccaaaatcaccatatagatacaaacctttatagtgttcgccgacctgttcaacaaaagcatcaatggcatcatagacctctatacgattactgtctgtgaaatctaaatcagcgatagtaacttttttgagagcctgaggcatattgatgagctgaatgcggttcttaatagcttccaaacgacggtattcgaccaattcctctgtttcaagataggacacatctgcatagccctcattcataaccaaaacaggttgatagccttttgcaatataagtctcatcttgtttgacaaaaaggtcacgctgactgatatattccaaaaacttagaaatggagagggtgatttcctgctgagtcaaaccttcttttttgataaaagcagcgacttcaggatcactcactatctcctgatagagttgctgataagattttgaacttggattggttgcctgcgacaacctgtcttgaactgatttcatcagctacctcccttactttcgttttctaacattcgtttcctaagcgcttccattcttgcctgagcttcaggactgttatccatgacaacctcttccttactccactcaggcacattgcttttctgtggctggctcgacttggtaacagcttgacctgtctttaactctcttagataaagaacagctgcctctgcactgccaattcccttgtaggaaaaatcattgcccagcttcatagcgtatttttcatttagattggctgagtccaccttgttaaaggtatagaggaccaagacattgataacttcgtcaagcagacccaaattggccaaatccgtcaagcattttcgttctgttcctgtcaccgctgccttccgttgctccttgataaaggacaggaaggttaggctggattttgatttcgcttcacgaacaatggcttgttcttgggcagtgaggttggcgctttctgttggcaatgactgacgtgactgctgcaagcgtttggtcgagatcatctgtccaatagctgttgctttagcctgccgataggtttccaaccaggtccaacctgcctgctctgctatgtaactaagcgcaataatatcctcagcttcatcctgaaaaagaagcttatctttagccattaatgccttgaaggcagaccagtcaaaatcatgtttcggttcaaaaacaactggagcctgcccatccatggtaaagacctgagaaaatgtttttgaaatattttgttcttgattgggttggtgaacaagcagattctccatacttgactccccaatcttccttgccaacaagttcttatacaagggtttcgctagaaaactttttacggtcagaggggcttgtagcgccaaacctgttaattcatctgcacgatagagttctaggagccccatggcagtcagaacatccagagccttctccaaacgattcatcccaaaatccatgtgattgagaatgacagtccatttgtaacgtccttgcccttgatcggcaaaactataaaagtaataataaagcgctaatgcatcaaaaccgataatcggctggtagcatttgctaagactgacaatatcaggtgtaaacgggctgatttttatataggcaaataaatcatttggtttcatctttttttcccggttttaccttacttcctttggagatcatctgcttaagcaaattttctagctctccaacatctttgaaagaacgataaaccgatgcaaaacgcacataagtgatttcatccaattcgaccaattcttccattaccaaattcccaatgacatcggattctatttcactatcaccttgtgctcgaaccttctgttcaatccgattcaccacttcatcaatatcatcggttgacacagggcgcttttgagcagaacgaataatcccattgaaaatcttttcacgtgaaaactgctctctagttccgtcttttttcacaacgactagagttttctcttcaatccgttcataggtggtaaaacgttgaccacattggtcgcaggaacgacgacgacggatggtattgccatcttcagcctgacgactatcaatgacacttgatttcaaactctgacattttggacaacgcatactctttctcctacataaactttatcacttcagtatagcataaaaatgacaaaaataaaagaaagcgagaattactcactttctaccaataattcatcttgcttcttcaatcgactggcaacccattcacgaaccaagcgatagacaaccgcaaaaattggggtaaagaagaccataccaagtaggccaaacaaattaccaccaatcagggctgcagccagggtaaagagggtcggaagaccaactgattgaccaaccacgcgcgggtaaatcacatttccttctatcagctgaataatctggaaaagggcgatagaccagagtgccaagagcggattttgtaccgccacaaagagagcactaatcaaacacgctgaaaagggaccgatataaggtacaaatgataggaccccagccaaaataccagccatgctggcataaggaattcctgagagcgaataactaacaaagacaagtgtcccaatgatacatgcctcaacaatctgactcatcaagaatcggtcataggtatcaacaataacttctccaatatagttcactactctgacagccttctctggcaaggtagcctgcaagaactttctcgtcatcgcctgcaagtgttccttgctccctaaaatcgctagagtgaagaagaaagccattatcaacgtcatagtgttcgaaaaaatccccgtcacattggacaccaagccagataaaatcggtgtgaccaaacttgaaataagtgttaaattcttcaactgatccaaaaagctggcaatctggtctccgatttgtcccgacaaaagaccatttgattcaagaaaattagtcagggcatttaccgattttggaatggctgtgctgctaaccgaaaccagttctgaaacagtcgtcaccaatgtaggaagaacaatcactaccagtcctgtcacaattaaagcaaatccaattaatactccaacaattgccaaagaccgcttggatttctttaaaaaagaaattttttcaaactgatcttctaattttttcatgggaacattgagaataaaggcaaaaatagctccaataaaaagcgaattcatactgcccaataattgttgaatagccccataaatactagaccagttgagaacagctaataatgtcgctccagataagagtatcaatatgactttttctttaaatgatgtattcataacttttccattcttacttattggctattattttatcacacgcttatagaaaaagaaagagggaaagcttccctcctctctactctaaatcaatcgcgcatggcatatccgacaccacgaactgtttttatatatgaatcttgatgtggcaaatccagtttaccacgtagatagcgaatatatacatcgacgacattggtctcagaagccgcttcatatttccaaacacgctcaagaagttgttctcgactaacaggctctgggctattcattaaggttgccagcagatcatactctcggcgggtcaaattaatcaattcatcacctcgagtcactgttcgattttgaaaatcaaccttcaaatcacgataggccgcatgcatgtgaacctgtttacagttattgtcaataaagtcacgaccacgaaaaatcgcagagatttgctccactaaatcactaatgacaaagggcttcaccacgtaggaaacagcataagagaggacttcttccccatattgactaacttctgtcggctcaactaccacaatcatgaccgtggctggttttatcgctaacagttctgtagccaattccttgctggacatgtctgaaagctgaaaactcatcagaatcaagtcaaaatccgtttcatgtgccaaggacatagcctctttccctgtcgatgcataatcaacaagatagtcttttttttgcaattccatggaaacaaaatgcgagagattgcgttctttaccagcaatcaaaattttcttagccattgtccatccttttctattctttcaaatggtgtaggaatcgtattatgactagaaagaagggcgcttccacgcccatcttttctattttgattcgctataccagtcgtaatggaagattccttctttatctttacggttataagtgtgagcaccaaagtagtcacgttgtgcttgaatcaagttcgctggcaagttttcagcacggtagctatcgaagtaggtaatagctgctgagaatgttggtacaggaactcctgcttgaactgccaaggcaacaacatcgcgaactgcctgttgatacttagctgttacatcaaggaagtactcatccaagagcaagtttgccaagtcttcatcacgtccgtaggcatccgtaatcttttgcaagaagcgagcgcggatgatacaacctgcacgccagatttttgcgatttcaccaaatggcaagttccagttgttttcttttgatgctacgcgcaactgtgcaaaaccttgtgcataagacatgatttttgagaagtacaatgcttgacggattttttctaccaattcagccttgtcgccttcgtatgcaaacggagctggttttggaaggaccttgcttgctgccacacgctcatctttgtaggttgagatataacgagcaaagacggattctgtaatcaatgacaatggcacacccaagtcaagtgacgattggctagtccatttaccagtacccttgttaccagcagcgtccatgatgtagttaacaattggtccatcttgaccttggtcatccttgcgtttcaagatgtccgctgtgatttcaatcaagtaactatccaattcgccttggttccagtcagtgaagatgtcagccatttcatccactgacaagccaagcaagtgctgcatcaaatcatatgactccgcaatcaattgcatgtcaccatactcgataccgttgtgtaccatttttacgtagtgaccagctccatctggaccgatataagtcacacatggtgctccatcttctggtgcttttgctgaaatttcttccaagacatctgccaccaattcgtaagcttctttttgaccaccaggcatgatagatggaccttcaagggctcctttttcaccaccagatacacctgtaccgatgaagttaatacctgagtttgccaattcttttgaacgacggatagtgtcttcgtagaaagtattaccaccatcgatcaagatgtcaccttcatccaagtgcggcaagagcgcttgaatggttgcatctgtaccaggaccagcttgaaccataagcatgatgcgacgtggtttttcgatagatgccacaaagctttccacatcgtaacttggtaccaagtttttacctgggttgcttgcaacaacatcttctgttttatcagcagagcggttgtaaatagctactgaatagccacgtgattcaacgttaagcgcaaggttgcggcccataacggccatccctacaacaccaaaatttgctttagtcatttgtttactcctctaatttgtatctcttttattatacactgaaagcttaaaattgacaagaattttcagataatttaactatcttgccaatctgagttagtcctcatctccaaataacccttgtaattgggcaaaaggactattggcttcttttttctcttgagctttttgttgaaaatcttcttcagtcattaaagcccaagctttaccagatggtagttcctgtccagcttcttcttcaggtgtcaagactttgattggtatagccagtaaaatattatctgctacactctcatcaaggacaatgtggtcatcttctactaccagtaccatatcctcatcaatcaaatcttgttctttaagaactgcttcattggcaacaaagagttcattgacgttttggacctcatgcaaaacaactggttgcagagaacgactggatgccaaggtaatatcataagtcatctgatagtccaagaaaaagaagcctgattcaaaacggacatttccagtgacttggactggcgacaagcctagaacttcaccatttcgagcttgcaattcttcctgtaaatccaaggttttatcaaagaagatgccatctagatttttctgaatatcgtaaatatgaaacattgtattcccctattcagctagttctgtgatgtagttatagacttcttgtccagcaactgcaccatttcctactgccgttgcaatctgacgaagttgattttgacgaatatcaccgatggcataaatgcctgattgggtcgtttccatcttttcattagtgataacccaaccagcttcgtctgtaattcctaggtccgcaactgtatcagtcatcggatccagaccgacatagataaagacaccaccgaagtccagttcgctgacttcctctgttttcacatttttgataaccacgctttgtacacgtaagtcatcgcccttgatttcttcgactacgctatcccagatgaagttaattttttcattggcaaaagcacggtcttggatgactttttgagcacgaagctgatcacggcggtgaacaattgtcacagactccgcaaactgtgttaagaagagagcttcttcgaccgcagaatctccaccaccgacaaccaagagtttttgtccacggaagaaggcaccgtcacagactgcacaatatgagacaccacggctattgtaagtatcctcacctggaatacctaacaaacggtgttttgcccccatggctagaacgactgtctttgtctccaaaacaccatcctcagtaatcactttcttaatttgtccttcttcctcaatacggactagggtgccaaaaatatggtccacaccgaatttttccaagggttcaaacattttttcagccaaggctggacctgaaatatggtcatagcctggatagttttcaatttccgcggtattgttcatctgaccaccataaataccacgttccaaaagagctacctttaaattgctacgccctgcataaagagctgcagtcatccccgcaggacccgcaccaattacaactgtatcgtacatatactttttccttctacgctttaaacattaataagattcccactactccaaaggctgcaatgggaattgtcatcacattaatcatcaacaaatcaaacaagaaatcttgtcgttcttgcaaggttttatccacaccctttgtcgcacgccagataaaccagaccagactagaagtgataatcaacaaggaagctattagcaatccttgtaaataaaaacttagaatgttttgtaacatctttttcctcgattactttaaaaggtttgacgcttggctttacgttctgcacgaccctttgcacgcgcttcaactcgcttggtcttgcgacgtttttcatcaacagcccattgaattttcttcttgtagcctggtttgacttttttctttttcttcttgaccaagccaatcatttccaaatctagtttttcacgagatttttcacggttagcacggcggtcacggtcgtaggtatcgacaaattcgccatttttcatttcttttggcaagaatttgatattgagtttttctagctctcgaatatctgcatcatcgcttggctgataaagggtaatggcaatgcctgataaaccattacgacctgtgcgccccacacggtgaacaaagaaggaaagatcctgtggaatggcatcattgatgacatgactgacgccctcaatatcaatcccacgtgctgctaaatccgttgcaacaatgtactgatagtccaagttcttcacctggttcatcatccgcttgcgctcacgtggaggaatatccccatgaatctttgcgacacgaagaccgttcgcagtcaaatagctatgcaattcatctgcacgtgtctttgtattgacaaaaatcatggccaagtaaggttgcatgagcttggttacttccaagatttgagcattacggtcacgccccttggttgaaatcagccagttttcaatggtatccgaaatgaccgtatgggtcttgatttgttccatgactggattggacaagtattttttcaaaaacggttggagtttctgcggaatggtcgctgaaaagaccataaattgcaagtcttttggcaggctgccagcaatcttatcaactgtttccaaaaagcccatgtccaaggtcatatctgcctcatcaaccacaaaggttttggctttatggatagcaaggtcacctgatttgaccaaatcatagatacgccctggtgtcccaacaacaatgtgaggctgactagcttgaagcttgtcaatttgacggttcttatccgtaccgccaacataattggtcacacgaacttctgtgtccgaatgactagccaactggcgtgccgcttgataaatctgagtagccagttcacgagatggggctgtaataacagcctgaacttggtccaattcctcatttaatttttgaaaaatcgggatcaagaaggtatgggtcttacctgaacctgtttttgattcccctatcaagtctcgccctgacaaaacaacaggaatcaatttctcctgaacttctgtcggctggacaaagttaatttctttcaaagcctcctgaatataaggcttgagtttcatatctgtaaatttcatagtttcctctttagttgtattccctctattatagcacgatttaggtggacaagcaaaaaggacggatacccgtcctaatcaactctcacttgcttcagtaaattctgcctcaataattccaagttccttctcttcttccaaacttgctttaaaggcctcagtgagttctaattcgccatcaaaatcaccatttatttttttcacaaatgtgtctgccaacatccctcccatgggctggaaggtaaaataggtcaaacctcctgaaatcagaccacccaaaataggaactgcattggcaatggtcttttcaacagtctttttggtaattttcacaccaatcactgcggctacctttttcaccaagggataccaagttgtcttggtcaaagcctgcatagctacttttttaccgatattagctccgactgtcttggatactttattgagaagaactgctgaaccacctgctccaaacatgacaccaatgtaggcaataatgcggatttgaacctcttctgaaatttccttcccttcaccaacaaataattcatcttcaccaaaaagataagcgatttgttgcgacaaattcaaggcaaaaccaaaatactgagctatatcagcagtacctgccgccaccgctgtaaatggattccccggtaaaccagctgcgaaagaaatcaaagatgttttcgtagtcatatcattaatgattttttcagcttccttacgcaaagcttttgtagtgaagaccgccgttggtccatccgcaataattttatctagatagggactatctttaaaacgagtcttcaaaaattcttcccgattgactttaaccataggaagttgactagcagctgtcatggtttgaataaccactccatataactgttcttgattgaattgttccatttttatcctccaccaattctctctctattttacccccccccgaccatatttgtcaaggtaaaaaaacagcatttctgctgtttctgacattttatagataaagaatagctagggtaatcaagctcatgatgagaccgactgaccagaggaaaaagtcaactttccactcgctccatttttcagcttttccggtcaaacctccaagctccaaatggtgatgaaaaggagtcatacggaagatacgacgaccttctccaaagcgttttttggtgtatttaaaatatgaaacctgcaacataacagaggacgtttcaatgacatagaccaggccgataaggaggagagtccattcctgacggagggcaattgaaatagttgccaacataccgccgagagccaagcttcccacatcccccatgaaaatcttcgctggtttacggttataaacaaagaaaccgagcaagccaccaatcatggtcacacaaactagaagaatatcaaatttttgctcattgaaggcgatgacagagtaagctagaaggctgataacaactgagatagaagccaatccatcaatgccatctgtcaaattaactgcatttgaaaaaccgaccagccagaacagaacaaatgggaaatagagaactcccaaatgtaccatgtgaccaaatacattcaattctccgccacctgctcctcttacgtggacaaagtagaagacaatacctcctaaaatttgtagagcaagcttttgtttaggattaagaccttcatttattttacggaaaatttttaaaaagtcatccaaaaatcctactacaccataaagggcaaggatgaagaggatggcaaggacaccacccgtcaacagttgaaaggccgttgcaaacaacaagctgacaagaatcgcaacaacgagaaaaactgttccccccattgttggtgtacctgccttaaactgatgttgtttcacatcttcgtgcatctgttgcccctcaatgcgtttggcttgataaaatgtaataaatcgtgggattaagagaacggttgctagaaaagctaccaatcccgacataagtgcgaattgcatgtcagtctcctaaggttattgttattttcttggttttattcaaagcggtaccgacctctacactttggtcgactacttttgaacccgttcctttataggtcacttcgataccagtccattcagcaaatatatccatattctctttggtgattgcgtacaagtctggcatttcttcgaatttatttgtcaggagtagaacctgttggttggcgattaccttacttcctttttcgactgaaacttttttaatttcagcaccgtttccaaggataactggttgaactaattgacggcgaagttcctcagccgactcgcctggtgccttaccaatgaggtctggcaattgatactctgtctcattagcgacccgtgccaatgctggtgcaggtgaatccagattcaaattgtctttcaacagcatcgcttctttcaatgtaggactgacaatgtcacgccaagacaggacatttaatacttccggttggcgaatggtcacatacatgataaattcagggtcttcagcagggatcatggctactacagagttgatgtaggcacctttaatatacccttgaccatcttcgctggcaatttccgccgtacctgatttgactgcaatatcatagccgtcaacctgaattgcaggcccctgtaagtcatgtgagtagagcgtaccataaacagggtcagtaccgacattaatcatatagcgaagtgtatcgtcggcagcttgttcagaaactggatttcctacttcttctttcgaagaaactctagctgtatctgtattaggatcataaagagctgagataaatttaggctctagcataataccattgttcgcaatggcggtaaaactacgaagcatctgtgcttggtttgcagaaatcccctgaccaaacgatgacatggcgatagaaacaatgttatcctctggtaccattcctggcgcctcgtcccccataccaaaacgcgttgggtagccaaaacggaacttagtgaggtaatttagccatttttcatctcccatctgttgctgcaataaggtcatcccaacgttactggatagggagaagccttgcgcataattgagagtcacagctgaataacctgcattgagggtccagtcattgattttcgcgtctgcaataacgtactcattattggtataatatgcatttgggtcaaaggtgccgttatcgatagctgacgctactgttagcaccttcattgttgaaccaggctcaaaggcctcttgatataagagtgaccgctctagcagtccttcttgtcccagaccttctttggtatctgaatcatagcttggcctttgggtcgtcgccagtatttcacccgtcttggctgaaaccaaagttgcattcgcatatcgccctttggcgttatcaaaaaaggtattcatattggtttcaagagaacgttgtagatcggctgaaattgtcgtatagacatcctgcccgtttactgtctccgtttcaaccttttctgtcccaggtaggacacggccttgactatctttctcgtagataacctttccgtcttgaccagccagaatatcattcagataatattccaaaccactcacaccctgtaaactatgactaccatccttgttttcaaccagattagctaacccgacaaaaattgaagcaaaatttccattcggatacatccgtcctggactagcgttaaaggcaatcccttcaatacctgccgccttcatctcttcttggattgacgacattgtactataggagatattcttacctaaggtcccaaagtatacctgcttcagttcaggttgattcagctgctccataacataatctgtctccattccgagatgctttttaaagatttctgctactttgctgaactgagaagactgcacatacaaaacttttttcagttctgacacatattctgtgtcaatgatggcatagactgtataggtcgttgaatcttccgcaataggaattcctgtacggtcgtatatcgtcccccgtttagcttgaacgataacttcacgctggtgtaccgcatcagctctctctgacaagtccaccccaaatttactatcggtgccgataatataggcaaagttgattaaaaagagaaaaaagacgaaaaccgtcaaaagaagtaggctctgtcctactcttcgacgattttttgacggaacatatcgttttttcaagacataccgcaagagtttattatttcttctgggcattattcggctactccaatattgtcattattaaaagttaatccagctttttcagcaatttccatcaagcgagctgaacgtgtcaattcattgacagcttgcttagcatcgttaatttcaatctgtttttggctaatgtcttgattgactttggccatgctagattgaagttgcaaaagccgcgtttgcataaagataattcctatcgcaagggctaatccagataatacgatgcttgaatagaaggctttttctacacgtgtgaaggttctaattttatcaccgataacccgcatagtggcttctctacgtttttcttgcaacatagactctctcctatttatgtactttcttagctacacgcagtttggctgaatgcgcgcgattatttgcctctaattcttcttgactaggtaagataggcttacgattgaccaattcaagtggcgccttcaagtcatctggaataaatggcaaaccttttggaacatcaatcgtacttgcttctttgaagagttgtttggtcaaacgatcttctaaagaatggaaagtaataacagaaatccgtccatccaaagccaataagtcaatggcctgctggatagattcgtctgctgcccccaactcatcgttgacttcaatccgaatcgcttggaaaatctgcttggcaggatggcccttcttcttaagttccttggctggcttggcagatttgatcagctctgccaactcagtcgttgtttcaatcggcttgaccgcacgcgcctgttcaatcttacgagcaatctgcttggaaaatttatcctcaccgtatttaaagaaaatccgtaccaagtcgtgataatcatagttattgaccacatcataagccgtcaaatgtccctcacgattcatccgcatatcaagcggagcatcttgtttgtaagaaaagccacgctcccgctcatccaactgtggactagatactcctaaatcataacaaatcccatcaatctctgttacacctagctccgccaagcgagtcttgagattacggaaattatccctgataaaggtcacttgtcccttttcaatgtaggatgccaagcgaatatgggcatgatcaatagcagtctgatcctgatcaaaggcataaagatgcccaccatccgtcaactgactgagcaggtactcactatgacccgctccacccagcgttgcatctacataaattccattgggtttgatgtctaacatatcgactgtctcatgcaagagaacagttgtgtgattaaattccttggtcatatcttttccattgtaccacaaattaaaataaaaagttgttgcaaactttttacaaaaaaactgtcaaatatagttgacaacttatatgaacaggtatatactaacagtaaagaaacatgtcacatatagttgacatcaacagggaggtctcccacatttttttacacttgtatgtcggatataattgacaacaatttaaaaggatagtcaacctatcctctcatttttagccaagtatgtcagatataattgacatagaaaggagggcacatgaaccgtgtcaaagattatcgcctattgcttgggatttcccagctggatctggccaaggctatcggcgtatccaggcagaccatcaatatgattgaaaacaacaagtacaacccctcgctagacctctgtatcaacctagccaaagctttacagactgaccttaatagtctcttttggaatcaataaggagttcatcatgaaagatatttttacaaaaattctcaatcaagcaaccaaggatttttattccattagtggtcccatggatgaaatgcgtctgcaagaaagctatcgcctcagtaacaccattgtcatgattgtttttcctatcctgctaataggaaatacgattgcacttcttattgccctacgacaacctgaaaaagttggctttctgctccccctaaccaatatactaatcatcggtttcacgcaagccttagcttcccaccttgccttgaaaaatggcattagtcaaagctatgaggatgaaattaatgtgaccaagctcaataaatctcttgtaaaaagtagtcgtagcacatttttcggagccttcctggcttccacgactgcccctgctttctataaagaatggtctgtatttcttgaagaactaacagacccgaccctcctactaggtcggttaattgttgcaggagctatcaccttcatccattactactattgtaagaagcagttacaaaagaaaattctcgcaaacaaataaaaggaagaaaaaccatgaaaaagaatatacgtcaagctcttatctctacccttatttttatcccgctctttgtcctctttcagctttggggcaatagcggagcagaaatcttgcacaccatcagccaagcaaaattttggctacaattgctgattgctgggaccatctacttcttaggctttgtttacatcttaccattgttcgttcaaaaataaggagctgcttatgaaaaaagaaacctttcaagataaattaatcaaacgattttacggtatcgcaggacccttggatgaatttcgccaaaaagaagcctcccgactaggcaatacctgctttatcctgctcttttggggcaccatggctcttaccctactggcactcgctctatccaaacgctacccagaagtcgttgcctatggctacccaactgctctactcctatccactctttcctccagtatgtatatgacatccaagatgcgccacagccaagtggacagtttagatgtagaggaactgactaccaaggaacagaagcagctcaagggagcaagtatcaaattcgccctctatttcactgccgttatgtacatttggactgttgtttttggtgcctggatggaggggctcaaccctttcgaccacctatttgacctccgaaaattccttgcagcctgtctaggtggtattttcacgggcattgctcttgaaatcatgttacgcaagcgcatgaaaaaggcagaaaacctaactatcagctctgctatttcaaaagaagaacccaagtggatcaaaaatatgattaaacgtttttatggtatccgcggtcctttagacgaataccgacaggccgaggctgatgctatcggcggacaggcctttatctactacttctacttcctagctcttggaaatgccatcgcctacttcctagcctaccgctatcctgtggaggtggctgcctactatccaatgataattgccttcttcagtattatcctaattggtatcgttaatatgcgcaccctccatgctgacctgcctcaatatgacatggaggaactaagtcctgaggaaagacaaggacagaccctcaatccactcgtttggggactgggtgttgccctgctatctagcctctttgctgggctgtcagacctctttagcctccagcttcccctactggcctccagcttccacgtcaaatccctcctcttcggtggtatgatgggcctctttgccagtctagccctgtctgcccttgcctatctgcaaaaactggaagcagatactgccaagaaaaaataaggagcagacctaatgaataaaccttttacacccaaacaaacctgtcgattttttgttctattttatgctttattttctgcattcttcatctactcttacatggtcaatgagccgattagcggttcattcttgctcatgttaccgcccattcagattatcagatcctttaaaacagaagaagaaaaacgatactttatcattcaagccatctttgccctgtttgccatgaccttgacctattccgtgggcatttggctaggacatgtcaaaccacatatcctcatccttcctgctggatttgctctggctattctttatcgattgtatttcaaaaaggagaaaacagatgaacgttaacaaaccgaaacttatactcactttgattgttctctcctatacaacattttgtagcctgtatatacatagctacctgactggggacaatccaccaatctttatcttaccgttcactatacttccaatcttgaatagtgactggcaaactaccagtccagaatcaaatgctgtccaagaagctatccatctttatcgtaaaccactgctatgttttctctttgcaggtcttgtcctaaccttctccattggatttttcactggtcaaatcaaaccactcctagctggattttggggaatatttgctctcctgctctttattggacaattgaaaaagtagtctgtatccaacattttacaaagtaggattttttctataaaatagattgtatatgacattcaaatccattctcaaacaactcaaactatttgattatatcttaatcggattcaccctagttttatcctttcttccagcaatttttacctacacacaactgacaacagatgcaaatgaggcaaaaacaattgcctatgtccgcatcaatggtgaggtggtcgaccaatttgaattatcaaaggacacaccccgtcaagaaaagacctactatcccaatgaagggcaatacaatatcattgaagttgatggcgaacgcattcgtgtcaaggaagacaatagcccagaccaaatcgccgttatgaccagctggattagccagccaggtcaactctccgtctgcctgccacataacctgttgattgaaatcaaatccgttggcggggaaaacactgacgaagaagaacttattttaccactatagtcttttagtttacttttagtactagctccaaaggtttgggaaatctttggaggttggagataaagcgaacaaagttcgcatcaaaagccgcaggcataactcaatgctttcttatttctaggcattgacttgaaacagtcccccagactgtttcaatcagacaaggcgagttcaaatactccagtggagtgtttgaagttggaaattaggaaacgatgtttcctcgctcgtcgaagtaataaaagaaaaactaaatgacgatataacaaagaagacacagcctgatgaacgactgtgtctttcctttttagaaaataagggctaaagcaagtatcaccacatatagcagcgcaaagagtacaaaactctttactgcctcgataaaggtttcccgtttgagttgctttttcaaaaatgtttctagactcttataagcaggccaaactccgattaaaccggccaatgcccaaattggtaagaatcctatcagacagtagattatccacagcaaccatggtaaacttgccaagacaaaatacaatttaagagcatttttcttgccaatatagtaaaccagagtataacgatggttgcgaatatcttcttctaaatcacaggtgttgttagccaacatgatattagcaatcaaggttaccagaggaatggacatgaaaataatttcaattatttttatccaagaaaattgcaaagtcatccactgaccgctcacttggctggtcagtagcaaatctggttgctgaataaatacagcaagaaagaagatgccaaatcccatggttactccagagaaaacttcacccagtggcattctcgaaagcggaataggtccaaaggtatagaagataccaatgaggaaacagagagctcccatcggtaggaggagccaactggtccgccatacaaggagtaatgaaaccagtagagaaaaaataagtagagcaaggacgattccaatcatctgacgaaaatctagggagaattttccaatcacattgctttcctgacgataggcttcatccttggccttgtggtagtccatgctattgttgatggcagttgtacacatgtcaaagctaaggacggcaataatgaagaggagagtattgagccaattgaaagcttgatagcgatacaggctccataaaatccccagggtcatcggaaaaacactagctaccttggtcttcatttcaacaaattctagaaatacagacaaactgagccctttagttgatttattcattaacaagatgatactcctcattcgttaattcaaagctttctttcaagccatcactcagatgaacgccctgctccttatcgataaaaacagcttctacaccgtcaatctgattgataaagtcaagacctttttccacacctagtaagaagagagttgtggagaaggcatctccttggatagatgttttggaaaagactgtcacacctgagatatcgttttccacaggatagccagttttgggatcaaggatatggtgatatttgacaccgtccacctctaagtagcgctcataaatacctgaggtaacaaccgaatcatgtgtccctggcacagaaccgaccgttgatccacgcacttggtctgggtcttgaactcccacattccaaccattttgtgtcgttggcgaatcccccataaccactacattcccacctagattaatgatggctgtcgtaatccctttgcttgcgaacaattctctaaccttatctgcaatataacctttggaaatggctcctaattctaaggtcattccttctttgataaagacagtcttcttctccttatctaaagtaatgtctttataattgataaatggcagagcagctttgatttcttcatcactcggcttacgtgcatcctcatctccaattttccacagattgctcacagctccaatggaaatgtcaaatagcccctgactttctttactcatgtcaatagctgtttcaatcacttcaaaggtacgttcatcaaccttgacagcttcttttcctgctgcctgattgatacggtagacatctgccccttccaagtttgtggacaacagactttccatctccttgatataggagacagcttcatccatcgcttcttcctgattttcatgataaatactcaactgcactactgtgtgaagtaagctttcactacgagtcaacggagttttcacaacagataaactttcgttttgtttaccaccacaggcaacaagcaaaaccatcagtaggcccacgaacaatagacttgcaatttttttcactgattttaccttcccccaaaaataagaagacacagtagccaaacaagtgcgactgtgtcttttctgtatagacttaattagtcaagttttacagtttctgtttttccttcagcagctgctgcaagaagggcttctgtactcttcttgaagtcttcagaagtatgagttgcacctgatacaacttcaacagctgagaggtcttgtttctcaaccaaagctgcattgagttgttcgattgcttcaccagcagaaactccagctttatctttcatgtttttgttgtactcttcatttgctgatttaagacttccatcttcagcttcgtagtcaaattttgactcactgatttttccgtctttaacagtcaatgtgtgaacaattttgtagccataatcgtctttgcctgactcagctttgtaagtaccatctttcaatactactgtttctgtagttgaagatgaagttgaagtagattcttgtttagaaccacaagcaacaagtgcaaataccgcaccaagaactaccaaacttttcaacacaactttagttgttttcataacaatactccttttgtaaagtaaatagttttatacttataatgatataccgaataaactaaattgtctagtatttttttaaaaataatgactaaaaactattgccaccaaattttgcatagacgcagtcgataactgtgatattctatctacaaaactcatcattttttccaaatagctaacaatcagtttctctgttttggcaatagcatgcgttgcaaaaatcctatctgtaaggatttccaacccttctgccgtaggggattgaatataagcccgcaattgctgctggatagacttgtcttctcgcatggcaaaaagtagcggtgcagtatagataccgttttgaatatcttgcaatctaggttttcctgattctgccacatccagctggtagtcaattaagtcatctcgtaactgaaaggccatgccaagtgcttgcccagaccgaaaagccatgctactgtctttcctagattggcctggtacaaaactccccaactgacaggcaagtccaaatagaaaagctgtttttccttgaatttgcttgagataggctttcatagtcatattggcatcaaattgattgagtagctgagataattcccctcgaagaattgtttccatcagcttatcattgcccaaatccaaatcatcacgtgacacctctagcaaacgaagcccctttccaaatagtcgacttgaataggccagaagataatcacccgtgtagatagcgattcgattcgaaaattgttgatgagccgccgtgactccccgccgtttatccgcgccatcaatcacatcgtcatgaataagagtcgccagatgcaggacttctaaatgggcagcaaaatatagctttgaacggctaatctttccttccgtcatttgtgcaaagagcagacagaggccggcacgcaggtatttccctggcgcctctacatattcaacaatcttcgctgtaactgctggatgcaggaccatcatctcagataagatgatggattttacctcttcaagtcccctctcaatctcaggataggtattccaaatttgatgtaccactaactttctatatttcctttattttttatccttgatacggtaaatatgcttcggctttccataaatcttcttatctaggaaacgacccaaccatggcataatccagtagtctagaccgaaggctctacccgcaccattcataagagaaatagctgctgggatgaaccaaatatttacccagtagaacatgcctgacaggctgaacataactaccaaagcaacggttgcagcagatacaatccatacaaaggcaccagcaatcaaagccagaccgataccgatttctgctactgtcataaatttttgcataaagagtgctacttcttggtttggcatcataaattccatgatagtagcaaaccaatcaggcattttgtccaaaacagccatcggtgcttcaccataagcatagctcaaaccaaaaattggttcagctacttctgccgcagcagttgccgcttgtgaggcacttgaaaccgcctcagcagcagatgctccagatactggatcagctaaccaagggaatgggaagacaacttgatccccaaaccatgatgttgttccaaatagaccaaaggctttcttgataccttcgtagagccatactgaaccataaaggacacgcattggcacagaccagagaagatttcctttgcctgaagtatgaccgccaaaaatgtttcgcttattctgaatgtcaaagaattcatgacgaacataagaacccatgtagaagaaactacggatagtaaagaagtagagtaggtttaccatgtgtttgacagccattgccataaagcctgacatgtggtatttgtccatcaagaaggctacaccgtagcgtgctccaatagataccataaacccatcatatttacctttgtagctatgtttttcgccgcccttgattgctgcaataatattacttgccgcagtatggcctgtctgttcagctgcttgtacaatctgtggagttggttttccttctgattcttcaaagtaaaccaagtcgccagctacatagacattttccttgcctttcgcttccatgaactcattggctatcaaacgacctgcacgtgctttttcaataccaaattcacttgcgtctgtattggcttgaacaccagctgtccaaatagaggtataggtaggaatttgacgacctgatgaaagtgtcaagctatcttcttgtacacttgctacaccatcgccaagaaccaattcaacaccttttttctcaaggtatttgcgagccttgacttgctctttttcagtaaccatagccaagatatttggcgttgcctcaacaaccttaagtgagaattcttttgaatccaacttgaactcacgcgccaaaattggtacccagtcaatcaactcaccaatcatctcaatacctgtgaagccagcaccgataacagtaaaggttaaaagagcgcgacgtttggcttcatcatgctcacgcatggcacgatagcaagcgtcaatcatgtggtcatgcaaacgttctgctgcttcgatagaccaaagtgtaaaaccgtgttctttaacacctttcacaccaaagtcattagcctcaccacccattgcaaggagcaggtaatcaaaatccagagtttggtgttccgcaactacttgtttcttatcgtagtcaatctcaacaaccttgtctgttaccaattgaacctttggatattttttgaagatacgttgaaggtcatacttgattgcattggcttctacacgcccagccgcaacttcatgcaactctgtcatataggtatggaaagagttcttatcaatcaaggtaactgttacatcttgatcctttttaaaagtttttcctagcaatcgagctgctgcaatccccgcataaccagcaccgacaatcacaatatttttcgtcacaatgtttcctccttgtgaaaatcaaaacaaattacatgtttccattatatcgtattccaagatagttgacaagcaaatttcaataattagtaatatacacaaacaaaacttgccatagtgaacaaaaacaagtatgatagtaaaatagataatcgactagaaagagttttttctctacacccatgaattctaaacgtcaaacacttaactttattacgatgctagcagctcaggcagttgtcatttctttgattgaacgactcatcacccccccatttgcttttgctccaggcgccaagctaggactgggaaatttgattagcttaattgctatttttaccctccctacaaaggatagcctaaaggttgtcgcactacgcttgctcatctcaacctttctgggaggcaccttttcaaccttcctctatggctttgccggaactactttgagttatgtaggaatgctctctgccaagcagctcggtccaaaccgtgtcagtcctattggaatttctattttgggcgggatgttgcacaatcttggtcagcttcttgtttttgctaccatcgcccgttctttctatgtactgaactacctgccaatcctcgcttttacaggaattttatcaggcttattggtcggactggctgctacctacctcctccaaaaggtcggacctttacgtcactatcatcaacaagtcttagcagaatggaaataaatctccctaggtcaactaaggagattctttttatggtccgcaccactttttcattgtccataataattcccccataatcctggtgtcacaaatataatgagccacctcatataaacaccacttataaaatccatggtaataaaaaataatgaagctttcaagaagagaaaaaaatcaggttctttgcgtgttttagtcgtacattttctttcttttgtgctacaatatcttcatcttttatttttttgagaaaaggtagaattatgtcaccatttaggatcaaactttctcccagtcagcgaatcattatcagtttcttattcgtgattctgactggatcaattttactaagtcttcccatctcacaaattagcacctctacagcaagttattgggatcatctcttcacatctgtctccatggtttgtgtgacagggctatttaccaaagccgttgctgaaacctattctacttttggacagattatctgtatgatgttaatccaaattggtggtttgagcttgataggatttattggtctcttcgctctacgcggtggtcgtaaaatgaatttcatcaatatggcgaccttacaagaggctctaaaccgatctgacacaaaatattttcgtaacttcctcaaatcagcttttggttttaccttggcggtcgaagcctttggagccctcttactgtcctttcattttgtacctgaatttggatgggcgagaggtttatttacctcgattttcgtagctatatcagccttttgtaatgctggttttgataattttggcgcaactagcatcatgcgctatgtggataatcctctaatcaacataacattagccagtctcattattatgggaggtcttggattctcggtttggtttgaccttcagacacaaatcgggcaaaaacgtagcctacgaaaactagggttccatacaaagattgttctaggcctgacagccattatactgaccctcggaactctgactaccttactcaccgaatggaacaacccttctactatcggacaactatcatttggccataaattattagccagctttttccagacggtcaccatgagaaccgctggttttgccagcatcgactatacgaaggctgaaccaatcaccctcttgctctatatctttcagatgatgcttggcggagccccaggtggaacagccggcggtattaaaataaccgccttcctaaccttagtgctctatgctcgtagcgagattctcggtctccctcataccaactttatgggacgaaccatcgataacctcagcatccgcaaagcttttgcgacattctcagtcttcctacttatgtttatcatagggctcttcgcacttgccctaacagatgaccgacaaccacttctatttttaatgttcgaggtcatgtcagcattagccactgtaggtgttacggcaaatctgactccaagcctaaccatggccggtcaagcagtcattatggcgctcatgttcttcggccgtatcggtccactttctattctcgcaagcctttctgttcgaaaattatctaaaaccgaaagtcttcaatacgcaaaatcatctatgcttgtttaaaaggagaaatcatgccaaactatactatcggaattctcggcctgggagtttttggtactaccattgcaaaaacattacacaattacgattgcaatatcattgctatcgataatcatgagcaacgtatcaatcatctagaacctattctcacacgcggtattgtcggagacatcaccgatcgctcgctcctacgtgcagcaggaatcggtaactgcgatgctgttgttgtagctactggcgaaaacttggaatccagtgttctggctgtcatgcatagcaaagttctaggtgttcctatggtcattgtcaaagtcaaaggaacaactgcgaaagaagtccttcttcgtgtcggtgccgataaggttatttctcctgaacgtgaaacaggtatttctctagcaaaacaactactccaccgcgatacaaccagcctctttgagctcgaaggcaatgtttccattgtcgagtttcacccgccagtaaaatggattggaaaaacactcggcgaattaaaactccgccaacattataaactcaatatcatcggttaccgaagtggcgaaaatcaggaattaaacatccaactgactcctgactatgtcttcaaatctgacgaactcatcttagcagtaacagaccataacactgtcgatcattttgaagaactgacaaattaatactcaatgaaaatcaaaaacagactagctccaaaggtttggggaacctttggaggttggagatagggcgaacgtagttcgttactacttacgcagatagaaccctgttactattttgtttcaaggtaacaggctgaaaggctccactggagcctttcactcatcaaatcaagtcaacaacgtctgattttgattttcgaagagtataaataacaaatttacgccctatactccgttttcaggagaaatattttatccctagaaagcctactagactatcatttatctagtgggcttatcatctgtcaaaaggagagattatgaatgatttaaccaaaggaaagccgattgcagtcatcttacaattcgctattcccttattgattggctctttttttcaactggcctataattttgctgattccatgattgtggggcatactttgggaaaggattcctttgcaagtgtcggttcgacagccagcctgatttttttaatcatcggttttgcccaaggtgttaccaatggattaaccattatttctgcccaacgctttggagctggcgacttagaggggcttaaaaaatcttttgtccacggactcttctacgcttccctcatcagccttttactaacagtctcagccttagcttttttgaaacctatcttggtcttaatgcaaacgcctgtgagtatcatcgaccactcccatgcctttctaacggccatgtttggaggattgacctttactattttctataattttctttcttcagccctacgcagtctcggaaactctaaaacacctctactggctctagttatcgcttgttttatcaatatcggtctggattttttctttatcttagttatgaactggggcgttttcggagctggctttgcaactatccttgctcaagcctgttcggtcctctttcttattttttacattatccacaaggtacctcactatcatatcggactagctgatttaaaattggatagaggtaatctcaagaaacatgcccagcttgcttttccaatgggatttcaagccagtattatcgccatcggagccatgaccttgcagtttatggtcaaccaactaggaacagacgccatcgccgcccaggccattgcccttcgtactgaccagttggctatgctgcccatggtcaatctggacttggctatcgcaacctttactgctcagaactacggtgccaagctctatgaccgtattcgagaaggagtgcgccactcattactcctcagcattgcttgggccattgtatttgcggtcattctcatcttgggcaatcgcttcttctctggtctctttctgccaaatgccagccaaacagtgctggacttggctcttgtttactacatcattaacggctcttgttactggattgttgcttccctctttattcttcgtagctttattcagggacttggcaagggctttatcccaacactagcaggctttggagaattgattttccgagcagcagtcgccatcatcggcatgcagtatttcggtttttatggaaccgccgccgctaaccccgccgcctggatcggaagcatcatcgtcctgattccaagttccatcatctttatgaaaaaattaaaagcaggacaaagtatttagaaaagaaaacgcatgaaactctcatgcgtttttaaaatagtattttcgtaagaattggatatgaaggacattccaaagcatagcatagctgatcgccactacaaaagctaagccatattgccaattaaattccaacacaaggctaacaaaaaggaatattcccagaaggaccaataataaactacttgcctttttctcatccctcttaaaataagccaataaggctttatcaggagaagctttcacttccttgaactgtttgaaactagcaccaagacttgctcctgccgctcctataattgcaccagaataatagtgtggaaggacatagaccgacaaataagcgaccgtaacataggcaagcaccaacaaggcatacaccagttttttcatgaccaacctccctatctatttgtttccgtccctattttaacataaattttatcgtaaatacaagtcaaaataatctactatggcaattgactttctaactcaacttctgtcaagagcgggctataataatcctgctcatcagcctagagcgggctgttgggtagcattttttagtctgagccagagattttttcaaggctttgctatagtcaaataaagagcttttagacaaggaactgaggtgcaggtagttagaacaacctctaggctgttctagcttggaaataagacttgcgaaacaagtcactttcgtagagtatggcaagctgaaagtgacgatgtatcaaagctaattcaaatgactatatctcgagtgattcgttattgtaagtaggctgcaagcacaaaaaaagactagaaaacctagtctttccttgtttattatcatttattcttaggaatttggatcatccaaactacggccatgcaaacctttttcacgttggacttgacggagtttctctggcgtcacatcattgccgtcttcatcgacgaccttgataccttcgatgtgggcacgcacactacggcggtagccctcgatgtactcctcacgaagagctgcttgttcctgcaactcctcctctgtcaagccttccgcctttttcttgcgggccaattcattgatgcgatcgatttttgcttgttccataaatgcctcctacttgctattcaagagattgaagaccgccacagcacttgccttatccgccaaggctttcaagagagccaagcggtttgctttgactgttgcgtcatctaccataaccatggtattgtcgaagaaggccgcgatgactgggctgagagcaaagagcttgtccaagttgcccgccatatcttctgtcaactccaagcctgccactgcagcagcaagggctttttcctggtcgttttcgaagagggcctcgtcaatcgcagtcacctccgccttttcagccaagttgaagacacgtgacaagttttccacggcttccttgtagtcagcctcttttgctttttggaaaatagcagagctggctgccagttgcagtctgaccacaaaagttgagctggcaagtacagcctcgcggatgtctttcggaatggtcttgtccatcatcttctctacacgagcacggataaagtccataacagctggctggttgtcataggtcaagctagcaaaattcaagctgtagagctccgcaatcaactgatccaatggaatttcccaaccaaatgcttccaaaatccgcacgataccctgtgttgcacgacgaagagcgtaagggtcgtttgaaccagacggaatcaagccaactgagaagaaggataggagggtgtcaaacttatcagccagtgccaggaccgcaccgaccttgctctcaggcaattcgccttctgctgagtttggcaagtagtgctcacggattgccgctgccaccgcaggtttttcccctgcaagaagggcatacttctcacccataatcccttgcaattcatcaaactcaccgaccatgcctgtcaagaggtcaaatttgtagatgtccgccgcacgcgccacatctgctttttcacccgcagacaaacctgccaagtcagccagtttttctgcgataactttggtgcgttccatgtgctcgtaaagtgagccgattttctcatggaaggtcacaactttgagtcgctctaccaagtcagcaatcttgagtttttggtcctcacgccagaagaactcaccatcttccaaacgggccaccaagactttttcgtttcctttaatgacattgtcaaggtactggtcattaccgtttcggacggagatgaagtttggcaaaagcttgccagccttatcccgcactacaaagtaacgctggtggtttttcatggaagttaccaaaacttcttctggtacttccaaatatttagtgtcaaaagaacccatgaaggcagttgggtactcgaccagattgagaacttcgttgagcaaatcttcatcaatttcaactgtcacgttgtgtttgtcctcgatagccttgatttgctcgacgatcatattttgacgctctgcggggtcagtgataacaaactgtgcacgcaagtctgcctcgtaagaatctgcacttgcaatctcagtttcatttccaaggaaacggtgaccacggctgatgcgaccagatgtaatgtccaagaagtccatatccaatgcttcatcgtccaaaagaacggtcaaggtgtggacaggacggatgtaggcgaatttgttggacgcccagttcatgctgacagggaaggtcatagccttcaagacctctggaatgcccgccaaaactgtcttagctggctggcctgcttcgtgtttggtcacataaacatactcttcgcccttgatctcgcggaattcaatgtcagctgtcgtcaagcctttgccacggacaaaaccttcagcagccttggtgaagtttccgtctgcgtctaaggcaatcttcttagcaggacccttgaaatcttctgtaagatcagtctgctggtctgccaaaccacgcacacgaacagccaaacggcgtggcgttgaaaagacatcaatgctgtcaaaagccaagcgattgtctgtcaaaaaggtcgccatgcggtcacgcaactggtgcatggctggggttacgatgtaggcaggaatttcttccaagccaagttcaacaagtaaattctttgtcattattctgcgtcctccttcaacaattctgctcgtgttgcttcatccaaaagtgggaaaccgagttttttccgctctgccacaaaggtcttggcaacgacacgggcaaggttacggatacgggcgatgtagccagcacgctcggttacagatacggctccacgggcatcgagcaggttaaaggtatgggaacatttgagtacatagtcaaaggctgggtgaaccaatccttcttccaaagcccgctcagcttctttttcaaacttagtgaagttttcaaggagcatgtcttggtcggatacttcaaaggagtattttgaatgctcatattctggctggataaagatttcaccgtatttaacaccgtcagcccattcgatatcgtaaacggagtcaacttcttggatataggaagccaaacgctccaaaccgtaggttacctcggctgtaacagggcctgttgccaaaccaccaacctgttggaaataggtaaactgcgtgatttccataccgtccaaccaaacttcccagcccagaccagctgagcctgttgaagggttttcccagttatcctcaacgaaacgaatgtcatgttccaaaggattgatacccaaacgctccaaagattccaagtaaagttcttggatattagatggagatggtttcataaccacttggaattggtggtgctgatacaagcggtttgggttttccccataacgaccatctgctggacgacgtgaaggctctacataagccgcattccaaggctcaggcccgatagcacgcaagaaagtgtatggactcatagtacccgcacctttttctgtatcataagcctgcatgagcaagcacccctgctcattccaaaattgttgtaaggtcaggataatttcctggaaagtaagtttttttgacatatttttccttctttctttaaatctaagtcttttagtttacttttagtactaggcaacaagctgcaggcagtactgaggtacggcaaagcgagttaacgacgtaataaaagataaactaaatgacgatgtttttgcgacgtgagccttcctagccgataccgctaggaaaggcgaactagtacagcgtctagctcagccgccatagcgatgagcgtgtggcaattcgactgaaaggagactatgccactggcgctgtgaaaagtaagtttctttgacataacagcctctttctatatatattgcaaaatggctagttctccacactcggtatagtttccacaaagacagcctgttctgccttgtccatataggaacaggtcatggcttctagatcgatgacccacttgtaaatccctgcttctgctgtttcttggcagaaggtgagaaaatctgtttgtccagcctgatgattgcgtaagatagtcacaaactggtccagattggcttggtccgaaacaggtatcgtcacttgatagccctgcttttccagagtttgccctgtctgtgagcgataggtaacctggccagactggatatccacaatattttccaccatacccaagtccttaaaataggcaatcagtttgggaaaatcaggccctgtaaactgttcatgcccgtgattgatattttctaaggtgaacattggtctcctttctttataatagctgtctttcaccttgagatgaaaaacaagaaatactcggtcggcagacaaaaagaaccgcattctcttcccctgtcaacagacataggggcgttgagaacgcggttccaccctaatttattacttcatttgtatgattctgattgagtcggacatggtcacgactgggaaagcgccaattatttcaagactggcttggctttcactctcccaagctcgctagacaggcttttgaaacaaccttctttcatgcttagtattgtagcagaaaaatcagcatttgtctagaaagaccactatttatccgaacacaatcccgctgacaaatcctacaaggctattgcaggcctatcgcaatctagtagatatttttctggtactactcccaagaatttttctgcgtgttgactgataaaatctagggcattttccaaatcttctactctatcagaattgaccaactccatgaccaagaaagcattctttgtctcatccgtaatcatggttcgctcaccatcgcgccaattgaaacagcgacaaacggcgcctttatcatccttatagcaaacttcacctggtaaagttggattattggtttcatcaccaatgagatagaattcatccccaccctcagtgaccgttagttggagattgcctacaaatgtatctaaatcttcagcaccacatggaagaccaaaacgtaaactcgccgcattataaatgtccactaatggagaaattgttgtgactggacggtcactagttgaacgtttcaaaagtgcttcgatactagaacgcgcgcctttttttgttttaaatttttgataggcttgacgatatgtacgaatgacctcattctcactaaaggtatcttccgtaagaaatttctgggcaattccgttgctttcttccagtaatttcactaattcatcaggcgattgcgccggcgttttataatctttcaataatagaactccaatttttgcatctggaaatagactccaaaaagatgaatcaacaacaaattgtgacatattctcactccttttatagaaaaatcagcaccctatgaacatcttctaagacctaacgacgttcataaaatgctgttgcatgactacccggtggcagtgtttatttaattaaatttattgtataaaaatgctttaaataagtcaaggactatccaaaatttgaaaaaacacaactaaataactatctatgactaatctttctcgtcaagaaatctccaataaactggattacgaagatgataactaaaatcaaaagagttgctaaaaaggtcacatcattattataccgtaggtagccgtatgatagcgcaacctgtcccaaaccacctgctccgatagctcctgccatggctgtatagccgaccaaggaaaccagggcaaatgtcgtcacacgaatcaagtcaggcagaccctcacgcagatagacaaggacaatatcccagaaagtcgcacctgatgcctgagccgcctcaatgacaccacgatccaattctgataaaaccacttcaacctgacgggcaaagaacggaaagactgaaagagcgagcggcaccaaagccgcctctgtaccaatggtttttccaacaataattttcgtcaaaggagcaatagccgccaacaagataataaaaggaatggcacggaagatagaagccaccttgtccaaaatccaataggcagtcttattggcaataaccccacgtggacctgtcaagaccaagaacaaaccagacaccaagcccataaatccaccaaaagcaaaggaaacaaaggtcatatagagggtcaaattaaaatgtgttaaccaacctgtctgaccatcccagcccaatttataaatatctggaaaattcgtttgaatccattctaacatctagttcgctcctttcaaaatcgtcacttccacacgcgcttccgtcactgcttcaatcgcacggtgcaactgaccaggttcacctgataagatcaccaccatctcaccgactggcgtatggtccaaaatttcaatattgccataaagaatattggcagatacttgatagaatttatacaagtcattcacaattgccgtatccgtatttgaacctgcgtacttgagttgcaccaaaatactgttctcaggcaaattcttaacaatatcctgctggtaaattttcaccaaggcctcatcaattcctgttgctgttttgatgaaatcctgtgtcaattcttcttttggatgagagaagatttctaaaactgaaccttcttcgatcaagcgaccatcctgcataacagccacacggttacaaatatcttttacaatctgcatctcatgagtaatcataacaatggtcaagcccaatttttcattcaattcctgcaaaagtgccaaaatctgcttagttgttttcggatccaaggcagaagttgactcatctgaaatcaagattttagggtcattggccaaggcacgggcaatggcaacacgttgtttttgaccaccagacaactgagctggatagttttcagcacggtcagaaagcccaaccaagtccaacaacttagcaactttttctttcttctcttccttgctcaaacccgaatgcttaagggcaaaggctacgttttcttctgccgtcatttgagccatcagattgaaatgctggaaaatcatgccgatttcacggcgtttgctccgcaattgagctggggtaagtgtgaccttttctccctcgtaaattacatcctcatcgatagtaattttacccgctgtcggcacctgcaataaattaatcactcgaacaagggtagatttccctgctccagaataacctacgataccgtaaatatccccttgattgatatggatggtcacatcctttaccgcttcaatcgtacgttttttctgctggaaagttacatcaatattatctagcttaatcatttccttactcataacttgcaattaactcctctactaattcaacatggctatagtagtcagcgatgctgacattttcatcacctgcatggtcgcgactgttggcatttcctaatccaaatcctgcaatcggcacgcccaaggcatgaaaaactgtatgcatgggtcctgtccccggtgacgtcggcaaaacagcaactccttctggcgtcaactttttagccaactcaatcacattgacaatggcagggtgggacatgtcacttcggtagctcatctctcctagagtgaagacaacctcaactttgtcaaaaccatgtttatccaaatgctggcgaatcttatctaatacatcatgcggctccaatccaggtaccagacggacttccatcttagcagaagcctgagctggtatgatggtcttgacaccttgaccaagatagccagttgacaagccttgaatggtaatcgatggttcaaaatacaaacgcttcagaaactcacgacgatcttctatcaaggttggaagggttagtccataaatatccgtcatagactgactggtagccagtgcaaattcttccaccaaggccaattcacgctcatttggctcttgaacctgatcgtaaatgccttctaccagaatttgcccatctgcagcccgcatggattgaagtgctgataataaataccagcttgccgaatcaatgacaccaccataggaagaatgaatatccaagtcagctgatttgacctgaagatcgaaggtcacaattcccttattcccaccagcaatttctagctgatgtaggctattgcgatgcccctgctcccagacaagcaaatcagcaccaatcaaatgttctttatattttgaaagatacttatccaagtcgacagaggctgactcttctgccccttccataataaaaatcacattgactggtaaatggccattctgtctagcttgatattttttcaaggccgacagacgagctgtgatatggcccttatcatcatctaccccgcgaccatagatatagccatcggaaatggtcaattcgaaggggttgcccttctcccagacctgatcggcatctgcaggtactgtatcataatgattgtagaaaatcaatgttttcgcatctggaaccgaagcctcaaacctagccatgacaaagggtgctgcataactatcatccaaaacaacctctgcaccagcttcttcaaatatatctttcaagtaagtcgccacatccagcaaaccaatctgctgagcaaaaatggatttctttgaaatcaagaccttcaacttttcaaaataggtttgaataatcgcatcattttcaaatgcttgaactttactatctgccatactttctcctcatactcaatgaaaaccaattaaatctactaaccaaaatcaaatattctcccacatttctgactttggttaagagattttttcttatctctataaaaacagatagagggctgaacaattctgcccagtcctcaacctatttacattttaccaaactggctcatccataccgtctgaagtctcttcaataacttttttcacttcatccgtgtggtaggcttcgataattttcttaatcgctgctgcttgctctgatttttcccaatcgctacgagctgcaatcaagttgtaccactgttttgaattttcatctttttgctctttgtaaagggcatttttgtaatccaaaccagcttccaacacaaatgtgttgtttacaactgctgcatcaactgagctaagtgagcttgctgtttggcttgcatccaactcagtgatcttcaagtttttcttgttttcagtaatgtcagcaatagttgccaattctgtaccagatacaccaaccttgatcaaaccagctgcttgaagaaggtagagagcacgactttcgtttgttgggtcgtttggaaccgcaatttctgcaccatctggaatttcttccactttagtgtacttgttttttccatcagctgtacctgagtaaagacggattggtgcgatataagtatccgcaatagcaaccaagtcttcaccattttcttgattccagttattcaagaagttatagtgctggaaggcgttgatgtctacttcgttttcagctactgccttgtttggctgtgagtaatctgtaaattgagtgaactccaatttcacttcatcaccaagaatttcttgaactttatcccaacgggcttgctcagaatcgctcaagctcatcacacctactcgaacagttgttgcagatgaatctgaacttgaagaagagttaccacatgcagcaagtacacctactgataaagcagccgttgccaaactaaacaatttttttaatttcataaaatgatctccttaaattaactgtatctatcttaacacagaattttctttctgactaattgactttttttatagaaagttataacttttcgttataacaaatacccttgcaattataagtattgataataaaaagagggatacccctcttaaaatatatctactaaatactgaaataggtctcgatgttgcttacaatcattgtataaaaattctggatgccattggataccaaacaaagcttggttccctctactttcataagcttctatcgtaccatctctaggatccaaacctgtcgccaccagtcctggagccaattctttgattcgttgctgatggaaggaattaatagggctcccttgggcaaacaattgaccgattcggcttttaggtttcacttgtaaacgatgggatgtcccagcaataccatcttgccaatgatgatccacctcttgttccaagcttccacctagagcaacattcagcaactgcatccctcggcagactgcaaaaatcggttttccctgatgaagggcttcctcaatcaaagccagttcaaattcatcccgttccaagaggtaatcattactatcaatcaagcgtttttgaccgtagagacttggatccacatgctgaccacctgacaagatcaacttgtcaatcatatcgatataatccttggctaagtcaggagttcccataggaataaccattggtacaccaccagcctgacgaacgctgtctgccaattcacgcgctaccgttacatatacgcgaccagattttgttggaaattcttgctcgtttcctgaaattccaatgataacttttcccataaaaagcccctttctttcattttttcaattgtagcatggctatctagccctgtctaatatagaagttttatggcttgataaaaaataactatcagaactacctataaacaattgctcataaacaagagtttgcctttagcagtttcatagataaaatctataccacgcttaagaaaaaactatactggagccagcataaaaaagtcaagcttgataaacaggctttttttcaagcttttatatagaagaaatatcaaaaaagtagctctctttcaatctgttatagtcaaaagttataactccctctaattttttacaattatacaagagtcgttttttctgttaggataggggcatagaaatattttggaggaaaaaccatgactactactattatcggcttcccacgtatcggagaacaccgtgagttaaaatttatcactgaaaaatactttagaaatgaaattccacaagaagagcttttggaagcagctaaagacttacgtgctaagcactggaatattgttaaagaagcaggcattactgaaatcccaagcaacgacttctcacactatgacaatgttttggatgcggcagtactcttcaacatcatacccaaagctgttcaagaccttgaattaacagaccttgaaaaatacttcgctcttgcacgtggttatcaaggagaaaaaggggacgttcgtgctagaccgatgaaaaaatggttcaacaccaactaccactatatcgttccagctattgaaaaagatacagaaatcaaactagccggtcataagattttcgatgaattccaagaagcaaagaacttgggcatcacaactcgtccagttttgattggtccattcacactcttacaattaactgattttgaagaaggtttaactgctactaatttcgctgatagcttagttgcagcctacggacaagtctttgaaaaattagcagagcttggtgctgaaaaaatccagctggacgaacctagcttggtcaaggatttgactgctgaagaaaaagcccttttcctacgtatctaccaaacactcttggcagataagaaaggtttgcaagttctcatccaaacctacttcggtgatgttcgtgatatttacacagaattgaccagcctaccagttgatgccatcggtcttgactttgtagaaggcaaggaaacggctgcacttgttgcaactggtttccctgctgacaagaccctctacgctggtatcgtcaacggtaaaaatatctggcgcaacaactacgaaaagagcctggctgttttggatgctattccagctgaaaatgtcgttataacaacttcttgctcccttcttcatgtacctttcacaacagcaaatgaagaatttgaaccagctatcctcaaccactttgcctttgcagttgaaaaactgagcgaattgcgtgatttggatgccatccgtaacggtcaaggcgaagttgctctcacagctaacaaggaactctttgcccttgagcgtgttggtcgtgatgcagcccttgcagaccgtcttgcaggactgacagacactgactatacacgcctaccagtctttgcagagcgtgaatccattcaacgcgagaagctaaacttaccacttcttccaacaaccactatcggttccttccctcaaaccaaggaagtccgtagcacacgcttggcctttcgcaaaggaaacatctcagaagaagaatacgatgcatttgtcaaaactcaaacagatgagtggattgcatggcaagaagaagttgacttcgacgtacttgtacacggtgaattcgagcgtaacgacatggtagaatacttcggtgaaaacctgtctggctacctcttcagtaaaaacggttgggtacaatcctacggtatgcgtggagttaaaccaccaattatctggggtgatgtaacacgcttgaacccaattactgtcaaatggtctagctatgctcaaagccgtaccaacaaaccagttaaaggtatgttgacaggtcctgtaaccatcctcaactggtcattcccacgcgaagatatttctatcaaagaatcaacccttcaaattgctcttgctatcaaggaagaagttcttgaccttgaagcagcgggtatcaagattatccaaatcgacgaagcagcccttcgtgaaaaactaccactccgtcgtagcgactggtacagcgagtatcttgattgggcaatccctgccttccgtttagtacactcaactgttgcaccagatacacaaattcacacccacatgtgctatagcgaatttactgacatcattcctgccatcgacaatatggatgcggacgttatctcctttgaagccagccgttcaaatcttgttatcctagatgaacttaaggctaagaacttccaaactcaggtaggtcctggtgtctatgacatccactcgccacgtgtccctgccgttgatgaaattgcacacactattcaagccatccttgctaaagtaccgaaagaaaaagtttggattaacccagactgcggactcaagactcgtggcgaatcagaaacaaaagctagtcttatccacttgactcaagcagctaaggcagccagaaaggaactctaatttatgattggtcaaaccccaagtctctcatttgaaatttttcctccaaaaccagcagtaggcaatgaaaagattatccaaactctcgatgagatgcaaggtttggcccctcattttatcagtgttacatgcagcaataacaatttgaacgtagaagagactactgtcaagttggctaaccatgttcgcaatgaattgcatattccaactatcgcacatttgccagctgcttacttgacaaaagaaaaggtccgatccgttcttcattctctcgatgaaattggtgtacatcagattttagcacttcgtggcgatattattgaaggtcttccccctaaagaggactttcagtatgcaactgacttgatttcctttatcaaggaagaagccccacattttgacattattggagcctgttatccagaagtacatccagaatcaccaaattctgtctcagacatcaaaaatttgaaaaagaaagttgatgccggttgctcaaccttggtaactcaactcttcttcgataacgaagcattttataactttcaggagaaatgttctctagcagacatcgaagtgcctattatcgcaggtattatgcctattatcaacaagaatcaggcacttcgactcttgaaaacctgtgagaatatccgcctccctcgtaaattcaaggccatcttggaaaaatacgagcacaatcctgaatctcttcgggcagcaggtctggcctatgctgtagatcaaattgttgacttagtgaccaatgatgtggctggtatccatctctacactatgaacaacgctgaaacagcacgcaccatccatcaggcaactcattcgctattcaaacattatagttagaaaactccccctgagcccaagctcaggggttattctatgccctgtgactcccaaagactacatgataaatttttcaccccatcatgacattaatccagcggatgtctaggtatgagacatcttgcttacaataacgaacagccatttaaaatacagtcacaaggagtaaaaatggcactaagaggagacagagaagcgacgaaatggaaaaataaactccatccgttttcaatttacaatcttcaatacagcattatgctgaataaatcacattgattcccatatattttaatcgtaaataaaaaaactgaccttcaaatgaagatcagttcaaggataataaacagattacaagatggctagaatgatgaaattcagaataaatagagctgtggcaccccaaaggattggatgaatttctttagccttacctgtcgaaacttttaccaagcaatagaagataaaggcggctgcaataccgtaagagatagagaagcaaagcgccatgaagaaggcggcaaagaaggctggaagcgcatcttcaaagtggctccaatcaacatcaaggaaggatgaaaccatcatgacaccgatgataatcaaggctggagctgttgcagcatttggcacaattccaatgaatggtaaaatcaaaattgatagcaagaagagaacggcagttgtaacagctgtcagaccagtacgaccacctgcagagatacctgcagccgattcaacatatgtcgttgtatttgacgtaccaaatagtgcaccgatagaggtaccaatcgcatctgcaaagagcgccttgtccatcttagagttaaagcctgtaccattttcgagagctttttcatcttcttctgagaaaataccagtcttacgacctgtaccgataaaggtaccaagtgtatcaaaggtatctgacaagctgaatgcaaagatagtcatcaaaacaagtggtagacggcttgagtcagcaaagagcgaagatagaccatcaaaagccgctaggaaagttgtaccaagctccgcaaaggctgtaccggtattgttatttgcaaaatcgattgtagacagatccacaacacctgctggaattccagctacagtcgttgcaataataccaatcaaaattgcaccacgcacgttcttaataaccaaaacagctgtcaaaagaagaccgaacactgtcaagagaacacttggatcagtaaaggttgaaataccaggtacgacaccaccaccagcaaaaactgagaaaacaccgtttgagaatgtttctgctgttgcatctgccggagcaacaccatttacagtaataatatctgaaccagatgtcaagaaggtgattaaattagagtttttaaaaccaagataggcaacgaatacaccgataccaccaccgatggcatgttgtaaactaactggaatcgccttgataatactcttacgaacctttgtaactgtgataaaaacgttaaacaaaccgcagaggaaaaccattgccaaagcttcttgccaagtaaaaccaagaccaataaccactgtataggtaaagaaggcattcaaccccatacctggtgccaaggcgtaaggtacgttagcaaataatcccataacaagcgttgatacagcactggcaattattgtagccaagaaaacagcctgtgttggcatacctgccacactcaatacgctcgggttaacgaacaaaatataggacatggcaaagaaagtcgtaagtcctgccataatttccgtagaaacagtcgttccatgttctttcaatttaaaaaattgatccattttttcatctctccttttaatttacgaacaataaaaacattataatcaaaaaacattataatttcaagttttttaatcttgaaaacgttattttattaattttcaactttaaacattcgtaaattccgaacgttgcaatcttgcaaaaatctatacaaaattacttgcttctttgcttttattatctccttttgttatactggaagttattagttcaagatgtggctacctacaagtactattctttgacgcataaaacaatttctcagcactctaactactacctaaacattattcactattaaaaactagtataacaactctagaaaggaatgctattaaatatgaagaaaaaaatcatagctatcgatttggacggcacattgctcaataatgatagccaattatctgattataccatctcaactataaagaaggtccgccaagcaggacacaccgttcttatcgccacaggtcgcccctatcgaatggctgaaaaattttaccaacaactagaactggatactcccatgattaatttcaacggttctttagttcacatccctggaaagaaatggcaatgggaacaaaatattttaatcgacaaaaaatacctactcgaatttctaaaagaagaagaaacattcgaggcagattttattgctggtgaatacaagaataaattctacatcactcaaaagaacttagacaagattgatcctgctctgatgggagttgaacagattactcctgatacactcatcaaacctgaattaatcactagtgatcctcattccatccttatgcagactcgtgcaactgataagtatgaacttgcaaaagaaatgaatgcctatttcaaagatgaattagaaatcaatacgtggggcggaccattaaatatcctcgaaacttgtgcaaaaggcgtcaataaggcaaccgctctgagctatgttcttaacctctaccaagcctctcctagcgacttaattgccttcggcgatgagcacaacgatgttgagatgctagacctagcaggaacagcctatgccatgaaaaattgtagcgatacacttcgtccgcatgccgacagattgacagcatttgctaattttgaagatggtgtcgcacgtgaactagaaaacctatttttatagacatcaaaaaacctgataaactatcaggtttttgtcatattcgttgcatatttttatcacttttctgaaacacgattatcaaaagtttcggaaatattttgcacttttaacacaaacctacttgacaaatgtactgaaaacgttttataatggtacagttcgaacatgaaagcccattcaatggtttttacatgaacaagaaaaatttaggaggatcaataatgagtattggaatcattattgcaagtcatggcgaatttgctgctggtattcatcagtcaggttcaatgatctttggcgaacaagaaaaagtacaagttgttacttttatgccaagtgaaggtccagatgatttatacgctaagctaaatgctgccgtggacgcattcgatgccgatgatgaagttttggttttggctgacctttggagtggttcaccattcaaccaagcaagccgtgtagctggtgaaaatccagatcgtaagtttgctatcatcaccggtctaaacttgccaatgcttatccaagcttacacagagcgtatgattaacgctgctgctggcgtggaagaagttgcggcaaacattatcaaggaagccaaagatggtatcaaagttcttccagaagaacttcaaccagctgaagctgctcctgttgccgatgctgctcctgttgcactacaaggtgctatccctccaggtactgttatcggtgatggcaagttgaaaatcaacttagcccgtatcgacactcgtctcttgcacggtcaagtggcgactggttggactcctgcttccaaagcagatcgtatcatcgttgcatcagatacagttgccaaagatgaattgcgcaaacaactcatcaaacaagctgcacctggtaacgtaaaagcgaacgttgtcccaatcaagaaattgattgaggtttctaaagaccctcgattcggtaacacacacgccttgattcttttcgaaactcctcaagaagctcttgaagcaattgaaggtggtgttgaaatcaaagaattgaacgttggttctatggctcactcaactggtaaaacaatggttaacaacgtattgtcaatggacaaagatgacgttgcaacctttgaaaaattgcgtgaccttggcgttgaatttgatgtgcgtaaagtaccaaacgattcgaagaaagacttgtttgaacttatcaacaaggcaaacgttcaataaatcgatctgttagtatagaaaggattacaacatgtcagatattacacttatttctgcaattctcgttgtcatcgttgccttcttcgctggtcttgaaggtatccttgacgaattccaattccatcaaccattggtagcttgtacccttatcggtcttgtgactggtaacttggctgcaggtgttatgcttggtggttctctacaaatgattgcacttggttgggcaaacattggtgcagctgttgcacctgacgctgctcttgcttctgtagctgctgcaatcatcatgatcaaaggtggcgacttctcaactgaaggtattgccgttgcaacaacaactgctatccctcttgccgtagctggtcttttccttacaatgatcgttcgtactatctcagtcggtcttgtacacggtgctgacaatgctgctaaagatgcaaacttcgctgctgtagaacgttaccacttgtttgctcttctccttcaaggtttgcgtatcgcagttcctgcggctcttcttcttgcaattcctgcagaagctgttcaagcagttcttgaatctatgccagcttggttgtcaggtggtatggccgttggtggtggtatggttgttgccgtaggttatgctatggttatcaacatgatggcaactcgtgaagtatggccattcttcgcacttggttttgcatttgctgctatcagcaaattgacacttatcgcacttggtgttatcggtgttgcaatcgctcttatctacctcaacttgtcaaaacaaggcggatcaggtaacggtggtgcttcatctaacgccccaatcggcgacatccttgaagactactaagagaagggagattcatcatgtcagaaaaaattcaactttccgtaagcgatcgtaaaaaagtttggtggcgttcaaccttccttcaaggttcatggaactatgagcgtatgcaaaacttaggttgggcttatgcaatgatcccagctatcaaaaaactttacactaaaaaagaagatcaagctgctgctcttgagcgccacttggaattcttcaacacacacccatacgttgcttcaccaatccttggtgtaactcttgcccttgaagaagagcgtgctaatggtgctgaaatcgatgacacagctatccaaggtgtgaaaatcggtatgatgggacctcttgctggtatcggtgacccagtcttctggtttactgttcgtccaatccttggtgctcttggtgcttcacttgcactatctggaaatatcatgggaccaatcatcttcttccttggctggaacatcattcgtatggccttcctatggtatacacaagaatttggttacaaagctggtagcgaaatcactaaagacatgtctggtggtatccttcaagacatcactaaaggtgcttcaatccttggtatgttcatccttgccgttcttgttcaacgttgggtatctattactttcgctgtagatcttcctgctaaacaattgtcagaaggtgcttacatcgtcttcccagaaggtactgttactggtgctgagttgaaaggtattcttggtcaagctcttagcggacttagccttgaaccaactcaagctcaaacattacaaggtcagttggacagcttgattcctggtttgatgggacttctccttactttcctctgcatgcacttgcttaagaagaaagtaacaccaatcacaatgattatcggtctcttcatcgtaggtattcttgctcgtttcttcggaattatgtaatcaaggaccccgctcttgcggggttttatgatataatgaatatctagggagagagcactatggcacaatcacaaaatacaagcgttgaactacaaaccacaggggtttcctacatgggctttggtggcaaggttggtaaatttctaattggtgacaaggcacttgaattctacccagatagcaacgttgaacgctatatccagattccttggtcagaaatgactagcattggcgcaaacgtttctggcaaagcaatcagccgtcattttgaaatttatacagagaaaagtcgattcttgtttgcatctaaagattctggtaagattcttaaaattgcccgtgagcatatcggcaatgaaaaagttgtgaaattaccgactcttatgcaaacaatcggcagaaaaatttcgaatctatttgccaaaaaataaaaattcaagtataatagtagaaacggataagtagcatctggctccttccagaaagtctgcggtcgctgtgagcagataggaaaaagttgtgaaattctaccgttatgaaattatcaaaatacaatcaagtgcacagaatgtgaagctggatggaaccgcggtaaatatcgctccagcatctctcattctgtgcttttttattctaaaggagacatctatgctagatatcaaacgtattcgtactgattttgacggagtggctgccaaattagctactcgtggtgtggctgctgaaaccttggcaaacatcaaggaattggatgcaaaacgccgtgaaatcttggttactgtagaagaattaaaagcagagcgcaacaccgtttctgcggagattgcccaagcaaaacgcaataaggaaaacgctgacgacaagattgctgccatgcagaaactgtctgcggatgtgaaaaacttagacgctcagcttttggaaatcgatgaagaattaaacgccatcatcaccgttcttccaaatacgccgcacgattctgttccagttggtgcggatgaagaagaaaacgtagaggttcgccgttggggaacacctcgtgaattcactttcgagccaaaagctcactgggatttgggcgaagacctagatattctggactgggaacgtggcgcaaaagtaactggtgcacgcttcctcttctacaagaacttgggtgctcgcttagaacgtgccctctacaacttcatgttggacgagcatatcgcagaaggctaccaagaaatcatcacgccttacatggtcaaccacgactctatgtttggtactggtcaatatcctaagttcaaggaagatacttttgagttggcagacactaacttcgtcctcatcccaactgcggaagtgccgttgaccaactactaccgcaacgagattctggaagaaaaagacctgccaatctacttcacagccatgagcccatctttccgttctgaagctggttctgccggtcgtgacacccgtggtcttatccgccttcaccaattccacaaggttgaaatggtcaaatttgccacaccagaacagtcttatgatgaattggaaaaaatgacagcaaacgcagagaatattctccaaaaactaggcttgccttaccgcgttttggccctctgtacaggcgatatgggcttctcagctgctaagacctatgacttggaagtctggattcctgcccaaaatgcctaccgtgaaatttcaagctgttccaacacagaagatttccaagctcgtcgcgcccaaatccgctaccgcgatgctgctgacggtaaagtcaaattgctccacaccctcaacggttctggtctagcggttggtcgtacagtggctgccatccttgaaaactatcaaaatgaagacggttctgtcaccattccagaagttctccgtccatacatgggtggggtagaagtgattaaaccttaagccatacaaagaaagagcgaggaaaaatcctactcgctcttttcatttatctaaaaatctactcccaaagtctttaattgttgacgaatcttatcttctagagcccgaatctctagtctatcttgttctagttgctgcgttacttgcccgagatcaatctcttcctcttcctcaaaagtatcgacgtaacgaggaatatttagattgtagtcgttttctacaatttcttctattgatgccaaatgagcatatttgtcaacagactgacgattgtgataggtctctacaattttttctaccatgtcatcggaaaggtgattctgattcttccctttctcaaactccttgctcgcatcgataaagaagacatccttggtctgacgattttttttgaagactagaatagtggttggaatgcctgtgccataaaacaggttagctggcaagccaataactgcatccaggtaatttttctcaataatcagtttgcgaatatgaccttctgctgctcccctaaagagcactccgtgtggtaaaacaatggccatggtccctgtattattcagatgataaagactgtgtaagataaaggcaaagtccgctttagaagctggtgctaacttaccgtattccataaaccgtggatccttcaatttggactcacgattgtcccatttagcagagtagggtgggtttgcaacaaccgcatcaaaactacgtggctgatcgattccaagttcatccaccccgtccggccagtcactttctaaggtatcagcattattcaaaatcatattgctgtagccgacctgatgcatcatcaggttcatccgcgccaagttataagtagttgtgttcatttcttggccatagaatttgatatgctggccctgaggtagttcattacgcactgttagtagcaaagaccctgaacccatggttggatcgtaaacagagaagctagtatctgatttttccaaacctaaagtaacaatcttggctaaaatcttactcacttgatgcggggtataaaattctccaccttttttacctgccgaagcggcaaactgtccaataagatactcatagatttctcccagaatatcctttccttcgtcatttttatactcaatgctatcaatcaacttcacaatactgttcaaggattttgcacgcacaaccgttgaattgcccaaacgagagtcccctagattgatgtcattaaagacgcctctgaaatcttccatagcatcccgattgagttctacattggcgttaaaatgatcgaaaatcgtctggtagtcactcgctacaatctcactgttatcaattttggctaccagtcttgcccaggtatcttcaggctcgatggcatacccaaggtgagaagctgtattttccaaatgctctaccaagtcattcccaactgcttctcgcgcataggcatcctgaacagtttctcctggagcaggactgataatttcatcttccaccaagaaacgctcttgatgctcagatagatagcgatagaacatgaaggctaggatatagttcttatattccgaagcatccatatttcctcgcaattcattggccatggaccaaatctgattagtaatggcctgaatagtttttgacatgtttttgtaatcctttcatgttgtttcattttttactcgaaatctcattttcgctgatgaagagtaataagctgatctaggtcggaaaagaagctaccgatggcttcttgttcagggagggtggggagggagataggcatgccaagaaaagtttctgtgtggattcttttagcttttctagagccatttgcaatatttccttgataataataaaattctttgcgagatacaaattctaacagaaattgcccgtttatccctttcaataaatcaaaagcaggcgaatcaagagttgattcataaccatcaagttctggtggaataattccaaaagcttgatttaaaaagtctaatttcccatatataaactggcctgattttcttatataatactgtgtagctgaactaccactataaatttctttcttggaaacaactcctctcccccataatcttacagttaacttccttgctatatctcctttactacctaaaattttactttctttcataaactcccccaacttacgctgtttccaagcgtccgtaaattctgggaatcttagctcaggaaaatcgtttccattccctttcggaaacattttctgtaacaaagccttcttcaattctttaacatcatctaattttcgctgatgaagagtaataagctgatctaggtcggagaagaagctgccgatggcttcttgttcagggagggtggggaacactactgtcgtggattttaaattagccttactaattgagctcacttttgtcccctgcattaaaggtaaaatttgattatggtatgcagttgaattaattagataacctaaatagtagggggcataagaaactttcggcctagcaactatcgtatgtaaaccagaaacaacattcttacccttaaaatttcgaacttcaatagctttcccaacagtcgagtcttctgccgcatccgcgaaaacaatatctccttcactaagtaaagcatctgcaaagtctgaaatcgtacttccaataattgatggaagttctttgttacatacatctaaaatagcatcatattttgttaaaatatccccataatgaatgttctgaacttcataaaaatacgatgataacttatctctagaaagtgagtttgtttttatggaaaagtccgccacctcccccaacttacgctgtttccaagcgtccgtgaatccggggaagcgcaatcgtggtacggttgatttttcttttgtcatagtccctccttttctactctctttttgttctatttctgaaagttatttttgcaatttttcggacgatttccattctattatacgctatcatccaacaaaatcgcaacctattgaccaaccaagtcgtcggccaaatcatatagtgcttgtctcaactgattgcggtactgaatcttgctcaagcctttaacagcatcaccttctgcccaggtctggtaatcgcgactagcttcttttatcaaggtacgtaagtgtccggtatcatccaagtcattctgaccatatcgatgtctcgtcaacaactctcgtagttcttggttgcggatatgttccgtcaagccccattggattcggaaagcaaagagcttcttgtcaatgtaaacatgcgaagcttcttggataatcttctgactatcaatccccttgactggataagcaaagttcatatcttgtgtcggaaaatcacctcgatagattgcatcccctgtttgacggatctgatcagcatagttgaggtcttccaaaccgcttgcaaatctatccaattcatccctggtagctgcggcttctaccatcttctcttcgtgaacctgattcagcaagagctcaaccagttcggtcaatttatcgtagtcaattgtcacttccttgatgtgagtcatcttgagttcaatttggtgaatgctaactttttgctctttcgccaaggttcgtttcaattcgttggctaagaccgtcgtcaaaagtttttcttcctctacagacattcccaaactttcaataaagcggtccggctgattgtaatcaaatccttcaatcaccccatcaacctcctctggctgatactgtttgagcttagacagtccttgattgtaagcacggagcaattctaacatagcctcacgctttttctcagacttcggaatatcattgaaatcacccgtcaactctctcaattggtcgaccgtttgtttgacttcagcaaatacttccttgaaaggcttagccaccagtccatttttttcattgttatttttttgttccgcatctgataaattagcagcactatcatctgcatagatggccaaggcctgattcatcaatttctcattatgagctggccagcggtaattgaccacccgtccaaaaggttttttatccatatcctccacacgattggtacgagaataggcctgaataagactggctcctttaagggttcggtcaacataaagagtattgagctcaggagcattgaaacctgtcaataactgatccacgacaatcaccaaatctaagtagttcttgtcctgagctgttctattgaggcgactaatcaggtcctctgtatacgcagcaacatctgacaagccaaaggacgtcccaaattctgtgttatagatcgtaatagcttcaagcaaaccagtatttgactcgaccatgctatcattattttgagtattcaaggcaaaggtcaatcccaccttcaagaccagacctccttgctctcgatgtagttgattgattcgttgaaactctcggaaatacatcatagccatgggtgtggaggccctgcctccacctacgtgggtggtgaacaaggcattgtaacgaccactgccagagcgatttgcccagtgtttgaagacatcttcgactaccaatcgaacatgctctggattttcatcatagacgctagaagtcaccgcatcatccatatcatctggacttagattggcaattttttcttcaatctgtgcacttgtccacttcgggtatttttgccgataaaaatctggtaagtaagttgtttttagtttttcctgatcgatggttgtctcaaaatctaccttaaaccctagtacattgcggtcactaatggcatttttaatagtgtaggcatgaagaagagggccaaaaatatcttgcgtctgcagactagcacctgtatcatctaagttgggagttcctgtatagccaatccaagccgctttcttaaaggccttttgaatccctgcaaaactatctccaccagttgagcgatgagcttcgtcaacgataaacacgatatgcttatctggtgatttgaaggattttctcttcaccagtgtatccaatttttgcacagaagtaacgataatcccactatccttactagtcaactgccgtgccaaggctgtggtattttgagtttctcgaatactgccaaaactattctccccagcttctggatcataagccagataatcatccttagtctgattggtcaatgcgatacgatccactagaaagacaaccttgtctaccttgggcattcgacttgccagccaagctgttttaaaactagtgatcgtcttccctgagcctgtcgtatgccagatgtagccaaccttgttacagcctagttcaaaatcgactttttttatcccctcaatgaccgcatgagtggcgtaaacttgatagggacgcatgactttcagcatttgtttctgcggtgtcccgtctaagatcatgtagttggtcgccatctgatgggccataggaatgctgagcatggaatccgcaaagtctttccaattccgaaccttactaccgtcagatttacgctgccagtggaaagcaaagtccttattaaatttttccgcagtggtattggccatatagcgaacattgttgggggcgatagcgactagaatctgcaaggtagaaaaaatatccgtatattgccgttcctggatatattggtgcatttggttcaatgccttgtccacatctaccgtatcctttttctcttcaatctgaataataggtaagccattaatcaacaaggttgtatcgaatatacattctcgtcgtccagggattttaggagtcctacgaatttggttcaccacttggtagacagtgtccccaccgcctatcttacgttggtcgaatactgtcaaaaatgtatgccgtccatcatcaagcgtaatttccaattcggaaacaccgctaattccatataaaaactggccagcctcataaggtgtcttcagatctgaaataatctgcttgacttgagcaaactcggtatcgctcaagggtttgtccaatcgatgttggttgtgttgccagagaatattacgaaaattttcccataattgctccgttgtcttgatacccggctcataagtccacagtttagatttgactgcatacaaggtcgaagaatcactaacagaccattctaaaccttctaggtgctccggttgtgtaatagtccctgtcgtaatatactgaatcaattctgtttcaaatgctaattcattcatgtgagtaaacctcctttaacaaatatgttagtcgtaaaaaatctccttgcgcataagcttgccgcttctgccgtaaggctaatccatctaaataaatctttcctagtttctgctgactatctaaaggaggcaaggcacctagctgtaaacttttcagttgcttgactgtatatttcattacctcactcccctgtaagctttggtaaaactgccgtctaatagccgaggattcattgatcagatacagtaagaaggccttatccagctttgcaatgggctcaattttgatatagttctgtgtatagagtaagcctgcgtgctccgctctcactaaaacagccttccccgatagtaaactaaagagtaagtctccctcctcgagcaaggtcacttctctatctgtcgtcacggtccgactatctatcacttcttcttctatcacctcataaccatccaattgatgatgttgctgattgtagaggatatagtctctagcatcttcccagctagtagtatccaagcgaacctgtaaactacctcccataaagagagccaattcttctagtttcataatttccctttctttgaaatttttcataattacattttttgataaactaagtatagcatcttctcagaaacctgtcaataaattatgtaatttacaaaaattaaaaaaggaggttctgccatgaacttatcaaaagaaaaattgcttttccatcactattatgcaaattggcttcggatttacaaggaaggagccattcgagaagtcactctcaagaaatatagaatgacattgcagtggcttatcaggctagctcctagtctgttgttggaagatttgaatcgggttcgttaccaagaattgattaacagctatgctaaaacacatgaacgacagacaaccatggattttcatcaccagttgaaaggagctattttagatgctgtagatgaaggaattattgaacgagatccgacacgtaaggtgattatcaaaggaagacttcctcgaaagaaaaagacaaaatacctcaaccaatttgaacttcatcagttgatacaagaattacgtctcggagaggagctgaattgggattggctcatcttattgattgctaaaacaggtattcgattctccgaagcccttgctctcactactcaagattttgattttcaccgacagctattgaccattgataaaacatggaattataaaggagacggcggatttttacctacaaaaaataaatcttcaattcgaaaaatccaactcgactggcaaaccagcacccaattcgccaacttattacagcacacccaacctgatgacctacttttcgtgaagaaagagcggatttacaactctaccatcaatgccattcttgaaaagcgttgcctaagtgcaaatcttcctgtcgtcaccattcacgccctgcgacacacccatgcatctattttattatttgccggggtctctatcgcaagtgttgctagacgacttggtcatgcaagcataacaacgacccagaaaacctatcttcatatcattcgtgagttggaaaaccaagatgttgatttaattatgcggtcactctccggactttgttaaattccatgtttctacttatagcaaaagacgaatccgtatggaaccgtcttttcttatatatagtaaaaaactgttgcaatgaaattgttcaccaagtgtacgattattggatagattaagtatctactcttgtaatagaggagagacaaaataataccactgccagcatcaatcaaccaagagcctaagtctgttggaccatgaaaggagccaaaaacgaggcttgaaacaactattcctaacaaaacctgtgatccaaataatttcttaaagaagtagcctcgaaatatgacttcttctacaactgctggcaaaaatgctgttgtcaagagtgccagtctaaaaggaactcccttcaaaaattctataatcgaagcatcgttttctgttgtggtaacaccctgcaattccaacaaataataaccaagcatatccgtcaactgcatgatagcaaaggctaatataactatcgccagaccgtcccaagtaagaatgttagggtcccagactggcagatcattttttcagcccgccaccagaaaaagactaaaagtccaagtgtcatcagcccaactattaccaaggtgacttgcgatttggacccttccaaaatcagatccggaaggacagcaagcactaagagaccaaaaatccttaataatagccaaatcttccgaccaagccatttcaaactttgacctagtttctccatactcttctcctcttccgcttcatcatatagagtgccttcaatctattataggatttcacgtaatgtcaatcaaactgttctgttgttgtgatacagttttacaaaaattcaatgaatttgtcaatatacactaaaaaacaaatacccttacgatgtttgttgccatcaccccactgattatttagcgaggtgtgtcatcttcaagtagggctctagtagagaaaagccctgaatcaagcgttccagcagttcctcctcggaggcaacggttctaaacggtacatcatacttgaccaatactttacgaatccgtcctgcttcaacggcttgtaataggctctgtctattctcctccgttccgtccaggcgataaaatacctgtccctcttgcacccaataataaagcggtgccgcaatcgagcagttcagaacacgattttgctgaagcagagaggtctccactttctttcgttcaataaaactgacttctactgaaatccctgcttcagttcccttaccatacaaacgaatagcaagagccgagtccgttagactagcagagggaaaacggtaataggtccaaaaatgtggtctgcaaatttgggcttgattcatccattgactgaccctctcaggcacaaagggactgacgtgctcagctaagactaaacttaatgtctgaaactccttgcgtgctgcctgtgctacattttttaaggctatcatatcgcctgccaaagctcctgctttttcaggcttgcaataatgaactccttgataatccaggtatctgcgacactgttcaagcatctgaatctcctatccacttctccatatagaccatatccatgccttcttgttcaggctctgttttgatggccttgtagccgagcttttcgtagaaagaaactaatttagactcctgcaaaaccgtgcagagaacccagcgtctaactgtcggataaaggctttccaattcgagcatagccttgtgaccatagccttttcctctgtggtctggatcaataccaatcaagcctagccagccctgttcagcgtcttcagcgaccgttgtccgtactagtccgactgtgtgctcttcctcgataatcttgtaatagctacaatttggtcgtgcaaagcgtgattggaaatagtccatagtttcaatggcagggttgtactggtcctgataggttttatataaagccgcaaatgctcggtgctgaataggtagcaattcttctgcgtttgatagatctgcttttactaacatggaaaacctcctgaaattattttatccattgtatcaaatctatcaaaaaaatactaggtcttcctagtattttctaaagcgttgatagcggttttcgagtagttgttcaagtggtaaggcttgtagttgagccaactgactgaccaggttgtccttgatatcagacaagacttccttggtcgctctgccattttccaaaaccaccctatcgaccacttggagtttctccaactcataagaagtgatcttcatgagttctgccgcttccatggctcgactgccgtctttccagaggatagaggcgaaaccttcggggctgaggacggcgtacatggagttttccagcatccagacctggtctgccaccgctagagccagagctccaccagagccgccctctccgatgataatagcgataataggcaccttgaggtcactcatctccatgaggttgcgggcaatggcctcgccctgtccacgctcctcagcaccgacgcctgggtaggctccggcggtattgataaaagtgacaacagggcgaccaaacttttccgcctgcttcataaggcgaagggccttgcggtagccttctgggtggggctgaccgaaattccgtttgaggttgtcctgaaggttcttccctttttggataccgataactgtcaccggctgacctgctagaaagccgatgccacccactacagcttcgtcatcacggaaattgcgatcaccgtgcaattcgataaagtcatcaaagagttgtgtggcatagtccaaggtcgtcaggcgagcttggtcacgtgccaaacggatcatacgtgctacatcactggtcatctgacacctccatgcattctcagcaagcgactgatggtcgctggcaagtcctggcgtttgacaatagcatcgacaaagccgtgttcctgtaaaaattcagccttctggaaatcgtcaggcagattttcccgaacggttgactcaataacccgtcgtcctgcaaaaccaaccaaggtctgcggctcagctaggataatatcgccttccatggcaaaactagctgtcacacctcctgttgtggggtctgtcaagaccgtcaggtaaaagaggccagcattggaatggcgtttcacggctgcagaaatcttggccatttgcatcaggctcatgatgccttcctgcatccgagcaccgccagatgcggtaaagaggacgactggcaaacgctcttcaatcgccaactcaaagaggcgggtaattttctcaccgaccactgtgcccattgaagccatgataaagtgagaatccatgattccaagggcaactggctgaccgccgattgtcgccttgcctgtcaaaacagcttcatccaagcccgttttttgacgggtggctgctaatttctctaaataattggggaagtccagcggattagttgtttcaatccctgtaaacaattcctcaaacgatccttcatcaactgtcaaagcccggcgttcctgggctgtaatccgaaaattataggaacagtgttgacaggttttctctaatcctaaatcattcttgtaaaggatgaccttacaagcaggacatttagaaaagagttcatctggcacctctggctttgcttgaggtgctgactctatccgcgaacgattgggattgatgcggatatatttgtcctttttgcgaaacaaagccatagcattctcctagtttacttttttagatcttcttgatagcggggtaaaaattcttccatgaggtaggcagtgtcataatcaccagccaccactcgcttgtcggaaatcaagtccagctggaagtccgtattggtcaccactccgtcaatttccaattcgtagagggctcgctgcatcttcatcagggcttcaaaacgattttccccatgcacgatgaccttggcaatcatagaatcatagtaaggcggaatggtgtagcctggataaacagctgaatctacacgcaaaccaacgccaccacttggcaggtagagagtggaaatcttacctggacttggggcgaagttgaaggctggattttcagcattgatgcggcattcaatggcatgaccagtaatcttcacatcttcttggcggacactgagttcctgaccagccgcaatcttgatttgctccttgacaatgtccacaccggtgacaaattcggtaacaggatgttccacctgcacccgtgtgttcatttccatgaagtaaaattcgcccttggcttcgtccaaaagaaactcaatggttcctgcattttcatatccaactgactgggcagcccgcactgctgcttgaccgatacgttcccgcatggtctgaccgatagcaattgacggagcttcttctaaaactttttggttattgcgttgaagggaacaatcccgttctcccaaatgaatgacatgaccatgctgatccgccaaaatctgtacttcgatatggcgagctggatagacaacacgctctatatacatagctccgttatcaaaggctgctttggcttcgctggaagccgattcgaaggcaggcactaggtcttcagctttttccaccttacgaatccccttaccgccaccacctgccgatgccttgagcatgacagggtagccaatcttttcagcgatttcaagggcttcttgactggtcaaaacttcaccgtcagagcctggaataacaggcacttgagccttaaccatctccgcccgcgcgttgattttatcgcccatggtatccataaccgtcccagaaggtccgatgaacttgataccaacctcttcacagagggtggcgaatttggagttttcactcaaaaatccaaagccaggatgaatggcctgggcacctgtcacaacagccgccgagatgactgcctgcatattgagataggagtctgtcgaacgggctgggccgatacagacagcctcatctgccaacatggtgtggagagcttccttgtcagcctctgaatagacagccaccgtcgcaatccccaactctctggccgaacgaatgatccgcaccgcaatctcaccacgattagcaatcaaaatcttctcaaacatgatgaatcctatctcctttttaacatagaataattatttatcacaagctcagcccttaactagtttgcaaaataacggaccgattcatactcaatgaaaatcaaaatcaggctagctccaaaggtttgggaaagctttggaggttggagatagagcgaacgaagttcgtttctccaagagcagatatactcctgctactttcttatcttatggtagcaggctgtcaagctccactggagcttgacactcatcaaatcaagtcaacaacggctgagtttgattttcgaagagtattattttccaatagcaaaagtcaacgtccccgacgcagccagttttccttccacctctgcctttgcctcaacgaccgcaatggttccacggcgtttgacaaatttagcggtcatgattaactggtcaccaggtacaacttgcttcttaaatttaaccttgtccataccggcataaaagaccagcttgcccttgttttcttccttggataactccaagacacctgcggtttgtgccaaagcctccatgatgagaacacctggcatgacaggatagtctgggaaatgcccattgaagaagggctcattaatggtcacatttttgagggcaacaatctcatcttccgatacttcaaggacacgatcgaccaagagcataggatagagatgaggaagcgcctctttaattttcaaaatatcaatcatttgatgcgtaccaatccttgtccaaattctacaacatcttggttggccaccaaaatctctgtgaccacaccgtcacggtcagctggtacttcgttcatgaccttcatggcttcgataatcatgagggtctggccttttttaaccgtatccccaactgccacaaaggctggcttgtcaggggctggggacaaataagccacgccgaccaaggggctttccactaccgcaccttctgccacggggctggcacctgcttctgctggagctggctcactcatttcaactgctggcacaggggctgggcttgcaggagttactggggcaagcggagcttctaccgctggactcggagccactgtcgcctgctggtttttactgaaatgcaagatctccccagcattgctatacgaaaattctcgcaaacttgactggtcaaactgactcatcaggtccttaatttctgtaatattcacttaggcctcccaacgtttgaaagcgatgactgaattatgcccaccaaagccaaatgtatttgaaatggcatgacggatttccatatcacgcccctgtccataaatgacatccgcttcaatatcttcagataattctgtcgtaccagctgtctttggtgcataagaatgacgcatagcctcaatgacagctgccgcctcaactgcacccgccgcccccaacaagtgccctgtgaaggacttggtggaagaaactggcgtgttcttgccgaatacggatacaatagcttggctttcccctttttcattagccggtgtcgaagtgccatgggcattgatgtagtcaatatcagctggctctaaacctgcttctgaaatggccaacttcatggccttaatagcacccagaccttctggatgcggagaagtcatgtggtaagcatcgcaagtatttccataaccaacgatttccgccaaaatcgtcgctccacgcgcctctgcgtgttccaaactttccaatactaaaaccgcggaaccctctcccatgacaaaaccattgcggtccttgtcaaatggaatagacgcacgttctggatcctcagtagtcgacatagctgttaaagcttggaaaccaccgattgcaaacggagtaatggctgcctctgctccgccagccagcatcacatcttggaaaccaaacttgatttcacggaaggcttcccctaaagcatcatttgatgaagcgcaggctgtgatgatgcacttgcagacgccatttgcaccgacctgcatagcaatatttccagccgccatatttggcagggcctttggaagagccatgggacgaatgcgttttggacctttttcattcatacgagcaacttgctcttcaatttccaaaataccaccgatacctgttgataagataacaccaaaacggtcactatccactgtctctgtatccagctgtgcattagcaatcgcttctttagctgcatagagtgcatagagcgagtaattatcgtagcgatttgtatcctttttcacgaaatatttgtcaaaaggaaaatcttttaattccgcagcattatggaccgaatattcactggtatcaaacttggtaatctttccgatcccaattttcccagccttcaaactattccagaactcctctggcgtatttccgattggagatgtcagaccgtagcctgttactactacacgatttaattttgtcattttcagtcctttctcattaggaaacttactgcatggtcaagccgccgtcaaccgcaatcacctgtcctgttagatattcttgcttggcaagaaacactgcaacatcagctacttcttctgtcgcaccaaagcgtttcatcggaatttgtgcagtcatagcttctttaatcttgtcagataaaacatctgtcatatcagattggataaagcccggcgcaatcgcattgacacgaacatttcgcccagcaacctcacgggcaatggctttagtaaatccaatcacacctgccttagaagcagaatagttggcctgtccagcatttccaatcaagccagatacacttgatagattgataatagcaccctcacgagcctttgtcattggtttcaaaacagcctgcgtcatattaaaagttccagtaagatttaccttcagaaccgtatcaaaatcctcttctgtcatacgaagagccattccatctttggtaatccctgcattgttgaccaaaatatcgacgctaccgagtgtttcgatggcttctgccaccattcgtttggcatcttgcgcgcttgaaatatctcctgaaatagctaggactttcacaccgtaatctgcaaagctatccagcaagtcctgacctagctgaccacgaccattaagaacgacatttgctcctaaactggcaaatttatgagcaatagccaaaccgattcctcgacttgaacctgttacaaaaacatttttatttgttaattccatgattcctcctcatgatttgtttaatactatttgtagcccctctatatcttcaattgctacaacatgcgccgtcttatcgattttcttgacaaatcctgataagactttacctggaccgatttcaataaagttagtcacaccagcttcctgcatggttgcgattgactcatagaaacgaactggttccatcacttgacggggcaagagggacttgatgtcctcttttttcataacctcggcttccgtattaccgaccaactctacttggaagtccgcaagttccacctgctccaaggcctgagccaattgctccgacgctggtcgcaggagagccgtgtgaaaggggccagatacattgagcggaatcatccgcttgacacctgcttccttcagcaattcaaccgcctcatccactgcagccacctcgcctccgatgacgatttgggctggtgtgttgtagttggctggggaaacaatcccagaggtaacagtcgcacagatttcttcaatcaagttgacatctgtgttgagaacagcaaccatcttaccagtccctgctggcgcagccagttccatatattcaccacgcttagcaatcagggcaatcgcatcttcaaaggccaaagctcccgatgccaccagagctgaatattctcccaaggatagaccagctaccatgtcgggttgtattccctcttcttccagcagtcgaaaaatagccacagaagtggtcaaaatagcaggttgggtatagcgagtctgatgtaatttatcctcttgattgtcaattaggtcgcgaatgtcataccccagaatctgactagcctggtcaaacgtttctctaactatcgggtaatattcgtaaaggtcgcgagccatccccactgtctgagacccttgacctgcaaaaagaaaagctgtctttgtcatcctattctccaaccgaagcccaacggcttgcctcttctctaatcactttggctgctccataatagatatctttcaaaatatcttcacaagattcttctttagaaactagaccagcaatttgaccagccattacggagccatttgttacatcaccatcaacaactgcattgcgaagtgctcccgcaccaagctcttcaatagcatctgccgaaattttacctgccaagaaatctttctctgcagctgcataagcagatgacaacttattcttgatggctctcacaggatgtccaacaatagaagctgatacagttgtatcaatatccttagcttttaaaactttttccttataagcctgatgggcattggactctgtagctactacaaaacgagttccaacttgcaccgcttctgctcccaacataaaggctgccgctgcacctgcaccatctgcaatacctccagcagcaataacaggaatagatacagcttcaacaacctgacgaaccaaggtcatggtggtcaatttaccaatatgacctccggcttccataccttcagcaataacagcatctacccctaatttttccatgcgtttagcaagggctacactcggtacaacaggaataactgtaatccctgcagcatggagacgctccatatacttccctggatttcctgctcctgtggtgacaactttcacaccttcttcgatgaccaagtcaacaatgtcatccgcaaaaggagacaaaagcatgatattgacaccgaaaggtttgtccgtgatagatttaaccttgtcaatatttgccttgaccacctctttgggagcatttcctccaccgatgattcctagaccacctgcattagatacggcaccagccaaatctccatcagctacccaagccataccaccttgaaaaattggatacttaatatcgagcaattctgttattttcgtcttcataattccctcatctttttttcttgcttacctaatcatttgaatatcaaatcattaggtaaacaagtgaagggttgccccccctcactcaaaaaatagtttgatatttcaatgttttgattatcaaagtatttaacttaagaaaaatgctacatagcactctccttaacagtcattattttgttttttcttcaacataagcaaccaaatcgcctacagtagtcaaaccttcttcagtgtcgatttggatgtcgaatgcatcttcgatttcagagataacttggaaaagatccaatgaatctgcgtccaaatcctcaaaggttgttgtaagagttacttcttcagcatccttacccaattcttcaacgatgatttcctgtactttttcaaatactgccatgatatgtgtctccttttgtaaaataaaatattttaatcttgcctagggcaaggaattaactaaagttgtaagagtagagttccccatgtgaggcctccaccgaaaccagccatgagaatagtctggcttccatccaatcgcaacattccgctctctacacattctgataagagaataggaagacttgctgcactggtattgccatatttatccatatttgctggaaatttttcacgcgccactcccaatttacgagccatcttatccaggatacgtatattggcttggtggagcaagaaataatcaacgcaatccacagtcatatcagcttgttctagcagctctgccatggttgccgtaacatccctcgtagcaaattcaaatatagctctgccctccatttggataaagggttgctgacagctttgtgtcgagaatggcgtctctttctggtctatccctgctgtcagactagcacctcgaccgccatccgttcgcaagatttctgctaaaaaggtcggttgttcacacgcttccagcaaaactcctccagcaccatctccaaataaaacagccgttgatcgatccgaccagtcgacagacctagatagggtctctgcaccaatgacaagtcctctcttatagactcctgaagcaagcaatttttccgctgttgatagcgcaaaaacaaatcctgaacaagctgcaacgagatcataggcgaaagcgtttttcgcgccaattgctgcttgaaccatagctgctgtagatggcattgaagcatctggagtaatcgttgctacgatgatgaagtcaatttcactagcatctagctgagacttttccagtaattttctagccacttgactagccaaatcactcgtcgtctctccagtaacaatgtgccgttgaccgatacctgtacggctacgaatccactcatcactggtctccattcgttgagccaaatcatcattggtcacaatcttcttcggaagatagtgggccacctgactgattttagcatggtttctcatttcaaatcctccaagaagtgatagagtttcatgagtcctttcttcattacctgatactctgcatcatccataccatctgtaatctgtttcaccatttcattgtgaaatcgttgatgcaaacgatagaccagtcgaccttttttggtcagatagagatgaacaactcgccgatctttggtcgaacgaatacgctcaacatatccttttctttccaaattgttcaagctagttgtaacagtacctaaggttaccatcaaagtccgagcaacatcactcggagtagctccatcaatacttcctatcacatcaatcgtgtgcatttccttaatcgaaatatcattgaatcggctaccacgcagacttgtttcttcaatcaccaacacattgttaaaaatggccgttagatattcatttacttttggatcttccaaaacaggcctcctttactttgatagtcaaagtataaaccataaaactttgattgtcaaacattttttactaatttaaaaattaatctcccgtaaacactggtctacgtcgttctgcatgcgctcgaactccctctttaaaatcctctttataggctaatgtttcttgtaaatccagctccaatcggcgataagactcccagtctttaaattgactttcccatgtcaattgtttgattgctgcataagaatttactgagcctcgcaagagtttttttatgacctgggcaaccgtcttttctagtttttctggctctgccaatttataaataatcccatattctaaagccttatccgctgataagccctctccagtcatcgccaagtgactagcacgattagccccaatagcacgactcagtagaaagagcccccccgcatccggcgcaagtccaacgcctacaaaggcttggatgaattttgtcttgctggaggcaataacaaaatcagctgccactgccatattagccgcggctccagccactgccccatctgtcaccataatgactactttagacaatttcttcatcgcaaacgaaatatcattcaccagctctgctatttttaccaaagaagcaatatcatcatcatcaactgcacgcttcatctcaactaaatctccacccacggagaaaatggaaccctgtgcttgaatttgtaaaattttgacggaggcatccccttctgcaaggcggattgcttctaagatttcttcacacataggaatattaaaaccatttgccacttccggtctgtttaaagttagaatcgctacggaatcaattacttcataacgaattgtttgataggccattctcttgctcctttcaaaatagtttgataattaaaagatttgaatatcaaacttcaatttcttgttttccattgtaacatagtttttaaaattgtcacttttttctagcaaggaaagtgtgacgtccgaaaaagatggaggccatcatcgcaatataaaatttagatatgctagaaaataacgtgtctaagaatctatattcacacgcaaagcgccttggctttttcactcatcaaggtagttttgcgggaaatactgactgtattttgaaaaaacaacctcaatatgcaagtctgaactgtaaattataggctctaagtttaatttacaactttcattttttcacgttaatacttttggaagatttaactggattctgagctagaaataccatttttcacgagaactgatgcttggactacaatataatatttcttaaaatcgcaataagtcaaaggcatcttcaagattgtctaccaatttgtctgctttcgactgatcaattccataatgctggtctcgaatagcccaaactgtcaaacctgcttttttagccgcttcaatccccttcgcactatcttcaaatactaaaatgtccgatttagctactcctgttgcactagctgctttcatataaactgtgggatctggctttggggcctcacaatccatcgctgagaaaacatgactaaagtgaaagcgtataccagcatctagtagagcacgttcgatttctgaacggtcggtatttgaagccaaaactacaggaataccttggatagttagtctctccaataccgctttaacttcaggaaaaatcctctctgcataaggggttggtcgcttttctttatacacacgatattcttcttccaaggcagggacatcccagttatcataatcatcccctaaaatccgttgccaaatttgactagctcttccgccgacaaatatagatggatccaaatgatcaaccgataaaccttttgtcgctaaaaaatccgctcgacgttgaaaatagaatgtttctgtatcaaaaagtacaccatccatgtcgaaaataattgcttttaccatactcgcctcctattactttaattgtaacacagttgaaagaaaaaaatgtttttctgaaattttcatacttgtctcttgttcgtttttcgataaaattcttggcaagatttgtctgaacatactgacaatttcatatcattctgctataatagaaaaaaatatccaaggagatgagaatgaaagttattaaatttgggggaagctcacttgcttcagctggacagttagaaaaagttttcaatattgttcaatctgattcagaacgtcgctttgttgtggtgtctgcacctggaaaacgcaatgccgaggatactaaagttactgatgcgttgattaaatattataaagaatatgttaacggaaaagatgtgactgccagtcaagaatggatcatcaaccgttatcaagcaatggttgacgaacttggtttcacagctaacagcatgaagaaaatcgcagacagcatcatctctttggccagcctaccaattgatgataacgaattcctttacgacgcattcttagcagctggtgaagataataatgccaaattgattgccgaatattttacccacagaggattgcctgcacgctatgtccatcctaaaaaagctggtattattgtcagctccgaaccaggaaatgctcgcattttgccttcaagttatgacaaaatcgaagagcttcgtgatacagatgaagtactcattatcccaggatttttcggtgtaactgttgataaccagatttgtaccttctcacgaggtggatcggacattacaggttccatcattgctgccggggtcaaggctgacctctatgaaaactttacagatgtcgatggtatttttgcagcccatcctggcatcattaaaaatccacattcaatcaaagaattgacctatcgtgaaatgcgagaattagcttatgcaggtttctccgtcctccacgatgaagccctccttcctgcctatcgcggacgaattccattggttatcaaaaacaccaataacccaactcaccctggtacccgaattgtacacaaacataccgagcaaacagttcctgttgtcggtattgctgcagacgatggttttgtcagcattaacttgtccaaatacttgatgaaccgtgaagttggttttggtcgcaaggtattgcaaattctcgaagatctcaatattcgctgggagcacatgccgaccggtattgacgatttatccatcgtagtccgtgagcgtgaattgactcctatcaaggaagaagagatccttcgtcaactcaatacgaaaatggaagttgacaaggccgaaatcgaacatggtttatctattatcatgattgttggtgaaaatatgaagagccatgtcggtgtaacagctaccgctaccactgccctctctaaacaaaacgtcaacttggcaatgatttcacagggagccagtgaagtttctgttatgttcgttgtcaaaaccgaagaaaagaaacgcgccctgcacgcactctatgaagctttttttaacgagcaataatcacaacgaggtcgcttcatactcttcgaaaatcaaaaccagacgttgttgacttgatttgatgagtgtcaagctccattggagctagtctgattttaattttcattgagtaccaattaaaatttgaataaacaaaaatagcttagaatcaacgtttctgacgatgcaattctaagctattttttattttttatactcaatgaaaatcaaaagtagcctaggaaacgaagtcgaagatagaactggagttcatcaaggcaagttgacaacggataattttgattttcgaagagtattggactttttgaccagcctcattatagtcttttagtttacttttagtactcgctccaactatctgggagatagttggagactggggacaaagggagtgggaaagaactcgaccaagataaaaagagttcgtcttcccaccccccgcacagttgattaggccagatttggagtgcaaaacacgaacaaatatgccaatcaaccactgcgctgagatgttgacacgaactctgagtagtggtcctggactttttgcccagcctcatcaaaagccacaggcataactcaatgctttcttatttctaggtgaccagctgatgtacttcgcttttttgttttcaggctcaggtacgaatagtccactggactattcgtatcccccagattgcttgcacagtcaatggactgtgcaaggtgggagataatacttgcaaagcaagtcacttttacaaaatcaggcaaggcgagttcaaacaatccggtggagtgtttgaagttggaaatatggaaacgatatttcctcgattgtcaaagtaataaaaggcaactaaatgacgatatttgtattatagacaatctctaggcaacacttctctaatattttagccttctattttagtgaaagaagcggattatcatcacgtttactcaaaaattcgaggtagacgatctgtcaaaagacaaaccacctcgtaatttatggttccgatgcgatcagcccactcctgaacagagatcgttttatctccatcttgaccgattagggtgactttttgaccaagtggataagcacgaggtaaacgaatggtgatctggtccatcgaaatacgccctacaatttcacaggcctgcccatcgactaggactgataagccttgtaagcttcgtacgagaccatctgcatatcctatcggaacggtcgcaatccattctgaatcggtgctgtgataagtagctccatagccaattgttgtgccagcttcaacctgctttacatgaacaatttcagatacgagagataaggctggttgaacaccaaacgggagttctagtactcgtccacttggattaagtccataaagaatgtttcccaaacgaaccaggttaaatactgtatcagcatgccaaatgcttgttgctgaattgctggcatgaatccagcgcggagtaattggtagaacatccaaaaattctttaaaaacagacagttgactctcgaagtgcgcctgttcaacctcatccgcagtagcaaaatgagtatagactccttcgatgtcatactctaattcttcaaggatagcaatcgcttgtagcaaatcggctatttttctaaaaccaatccgccccatacctgtatccagcttaagatggacagttagaccagataaatcagcctctaagtcttttgcatcttgcaaccagtccagactggcaactgtcacactgatattgagttgatgagctactggtaaaaaacgtacaggaaccactcctaaaatcaagataggatgctcgatacccgctttacgtaactctaatgcttcatccaaattcgaaacacaaaaaccagctgcttgactggataactttttcgctaccgcaacagctccatgaccataagcattcgccttaacaacagcaaatgcttcagtcttagggggcaagttggtcattacttgctcgaaattttccgcaatcgcatctaagttaacccgaatttgcgtgggtcgatgttcactttcaatcatctttctcctccaaaatcacactagcttgtacaaaatttcctgaatggctaatgctgagccaaatattcccatcaaagggactcttcgtcacatagggaactcctttgctggtattcagaatttcaatatcatgaaatcctatcttaccaatgcctgtccccaaggccttggtcagtgcttctttggctgaccaacgtccagctaaatattctagctgacggcgaccggacagactttgataccgttcaaattctttctctgtgagaatctttttgggaaacccttggtgtttgattctggcactttcaatcgcctccatctcctgaaggtcaatgccatgtcctactatcattaatcggtctccttttgcatagtcacttcatttattaaaataaacgaactgactctagtgacttgtctaaaaattgcaaaaggactggacagccgtccagtccacgcgtcattcctatttacggccgtgacaatttttaaatttcttaccagactggcatgggcatggatcgttacgatcaacaccttcaaaagatacattctcctgaattgcatgcgattggttcggcataatattcttaacagctgtcgtatgtgcttcttgacttgtacgctcacgctcaatattgtcatgaatttgcgccttcatcatcaagcgggttacttcaaactcgatagccccaatcatatcgttgaacatagtaaatgcttctgattgatattcaacgattggattgttttgagcgtatccacgaagactgactgcattgcgcaattgatccaaggcatcaatatggtctgtccatttgttatccacaacacgaaggataagaactttctggaattcgcgtacacgttcttcatcgcgtaattttttcacttgcgaatcatagactctcaaagcacgttcatagagctcttcgacaatctctttctgattcattgcttcaaaagtagctttactcaaggtatcatcttcaacgagatttgcatgcgcaaatttgataataccatcaatagcttcatctttcgaaccaaggaagtgacccgcaacttggcgttcaatcgtccgtttcatcatcgctttgatttcaggagccaaatcacggtcagcagtaataacatcctggcgttggcgatagatgatttcacgttgctcacgcatcacatcgtcatattgaaggacttgtttacgtgagtcgtagttgttcccttccacacgcttctgagcagattcaacttgacgtgtcaacattttagacttgataacggactcttcttctgttagattcatacgctccataaatactttgatgcgttctgaaccaaagcgtttcatcaagtcatcttcgagagatagatagaattgtgattcacctgggtccccttgacgacctgaacgtccacgaagctggttatcaatacgacgactttcatggcgctcagtaccaataacacacaacccaccaagttcacgtacacctggacctaacttaatatcggtaccgcgtcccgccatgttggtcgcaatagtgaccgcaccacgctgaccagcattcataataatctgtgcttcacgatagtggtttttagcattcaatacttcgtgagggacacctgcagctaccaatttttgagaaatcaaatcagaagtttcaaccgcaactgtaccgaccaagacaggttgccctttctcatagcgtctcttcacatcagcaataacggcattaaatttgtattctagacttggatagagtaaatcttcgtggtcaacacgcgcgattggacggttggttggaattggtacaacacggatgttgtagatttcacggaattcttcctcttctgttttaccagtacccgtcatccccgataactttttatacatacggaaaaggttttggtaggtaatagaggcacttgtcttagactcgttttgaaccggtacaccttccttagcttcgatggcttggtgaagtccatcagaataacgacgaccttccatcgtacgacctgtaaatggatcgataatcatgacctcttggtcttcattgaccagatagtcaatatcataggtcatgatgtagttggcacgaagtgcattatccaagaaatgggtaatggctacattttcaatatcgtagaggttatctaacttgaagaatttctctgctttgtcaatacctgaatcagacagtccaatcgttttagatggaatgtcaatgatgtaatcttctgttgtcaaagatttaacaagattatctgccaagaaatacaactggtttgtttccgaaccttgtgcaccagatacaatcaacggcgtacgagcttcatcaatcaagattgagtcaacttcatcgaccaaggcataattgagaggacgttgaaccatgtcttctgcgcgaacaaccatattgtctcggagatagtcaaaaccaatctctgagttggtcgaataagtaatatcgcagttataggcctcacgtttttccaagggtgatttagcagctaagttgataccaactgatagaccaagccatgaatacaattcacccatttcagtcgcatcacgggtagaaagatactcgttaaccgtcactacgtgaacaccttgaccagacaaggcattcaaataaacaggcatcgttgcagtcagagttttaccttcacctgtacgcatttctggaacgtcaccgttgtgaagaacgattcctcccataacctgaaccttgtagggatagagacccaagacacgtcgagctccttcacggactaccgcataagcttcgtacaaaagatcgtcgagggattcaccgttattgtagcgctccttaaattctgctgtcttagcttgcaactgttcatcagtcagcgcttccatttcatcggcatacgagaagaccttgtctgccattttctcaagttttcttagctctcccttatcattttcaatgagagaacgaagtacatttgttaccatacatttcatcctatttcagttttagtcaataatatattgtagcagaaaactaggcaattttcaaggtttggcactaggatacagcctaaataaatgaaaatgctagcttaatattactatttttaccacaaaacacctcctagtcacaataactcctaggaggtgaaaaatttataaaattttaaatgaggaatctgcgatatatcggagatttagaaattcattaaaagctcagttatcatattattcagttaataaaagctcacatgaataattttctacacaaagataaacgtcatctttaacctgtgttaatatattattttcctcgagaaaaatatctcatgaagaaactagtagataaagctacccaaattgttactaagctgttaagtacattttccgaagtaaggatctcttttttctctggctctcgattctcaattgttgcatttgaatcgaccactttttcttcctcaacagaattgttactacgttcaagagaggtaggcactttcaccttgccagctactgcacttctctcttgagaagaagttgcaacacctacaggctcaactgttgaaattgcttcttcaaacaatgtcgcagataaagagtaaggttgaggcaccgtgtctgaaccagcatcttgaacacgaatatctgatgtcggaacagaaactgcctcatgagtatttgcttcaactccatttggcgtagttgcatctgctttctcgtctaaatgttcatttttaggaacctctaaagtaagtgaagcagaacttgtttgtggagcagaaaccagtgggtcagctacttcttgtttagctaccaccacctctgtagaattagcttccggtgaagttggggatgctgaactactcgcaactacacttggttctgttacttctgttgccacttctgctggagctgtttctgatgaagttgggatttcagaaattacttgtggagctgaaaccggtgagtcagctacttcttgtttagctaccaccacctctgtagaagctgtttccggtgaagttgggatttcagaacttacttgtggagcagaaaccggtgcttcagctacttcttgactagttgttaccgtctctgtaggagttgtttccggtgaaggttgagatgctgaactactctcttccgatacttctgttgccacttctgctggagctgtttctgatgaagttgggatttcagaacttacttgtggaacagaaaccgaaggttcagccatttcttgactagttgttactgcctctgcagaattagtttccggtgaagttggggatgctgaattactctcaactacacttggttccggtgtttctgttacctcctctgtaggagttgtttccaatgaagtttgaggtgctggattactctcaagtgcacttaattccggtgcttctgttgccacctctgtaggagctgtttctgataaagtttggatttcagaacttacttgtggagcagaaaccggtgctttagctacttcttgactagttgttaccacctcggcagaattagtttccggtgaagtttgagatgctgaaattacttgtggggcagaaacccgtgattcagctttttcttgactagctgttaccgtatctgtagaaatagtttctgatgaagttggggatgcagaacttacttgtggagaggaaactgtattaacctgcgcttcactcgattctttggatgaaggctcaacatatggtaatttagcatcactttcttccttagaatcaactgtattctgagctgtttctgaactcggtgaaaccatctctgtatttcctaaagatgaagtctctgttttatcctctaactcagttttagcttgtagtgccttaggagctgctggtgtttgttgagaaggagcagctgagattgtttcctgtgttgaaggagttccttcaagctcctcagattgctgtgcagaattaacacttggagccgaagcatccttggaattttggctgacttcatcagaattagcttggttttcttgcaattcatttcggtttctatcatcatcagaatttgtgttatttttctgacgattctttagataactttgataagtttctccttccgaaaattcttttccagccttcgcattcatttgccccaagaacactcgagctaaatccattgaattttcgagtgctttaaattcttcttctgtaatcttggagagagcactcaatttatcaatatcagaattgacaaattgtaaaacacgatcatacccctcttgtttatcatctttatcgtctttatccgttgctttcgtttcttctactttacgtttcaaagctttatagatgtctagcaaatgatttttcttattttctgttatataagttggctcaacatatgcaatataatccaaaccaaccaaggacttttctttgttgaacaacagtaaatctgctgttttttgtttcatagcccaactctcataattactatcaataatcatgtagttacgctccgccttaggctcctgtcctgcctcaacaacatcataactatcctcaccaatagtagaaaagtgtttctcgctatatttagctgagcgctgatgcttattccctgtaataaaacctgtaccgtcaatggtgtgccactttttatcataataaacacgcgctgtagcatgcgggacaccttctgcatttttcccaacaacaacataagcaggaagccctaacatattaaatgcacgggccgcagtagtgctgaaacctacacacatcgctttctgacgttcagtaaccgcgaacaaatctgatcctaagtagtaattgatgtctgcataattttgaacagccttattagcagcttcccaatcatatgttgtatgattggcaacatactgaacaaatgccttaactttatcgcgttcacttgattgcttcatagcttctgaggactctatcaacttatgaatcaagtcatcatttgctataaaacgctctttggtaacgtttatatttttaactgaattatgagtatatttactataatcctcatagtacttattatcaactgtaagaccatgcgagtaaatagtcattccattaatatttttcaaactattctcagcagttcctagacccgcagcatttaataactgccgtttattggagtcaagctcaatcttaaatagtgcatgaatccgttttggctccatactattatgtaagtcgccatttcccgaaaacctcaactctctcatctgattatgataatcttcctcattatgagcaataacatcacccttgttcataacaaggatatgtggaaagtcatgaatattttgagtaactttaccattgattaccaaaaaattgttgtttttaccaaattcttccaattcttcccgagttgataatgttcccagtcgattttcaaatcctaatttcaaaacatgaaattgtcgttggtccgaggagtagtctttcaattttttagaaaatgcttcccagttcagaacctctattttattggtgttttttggcgattgtaaatgtgagttttcatctgcaaaaacaaccggttgtgatgttccgatagatgcaagcgcaagaaccgaagtagaaagggtaagtgtcaaaataagccagcgcttaccatgctgttgaattggaatcataagtcctccatataagtacttctgagaataatttcccagcctaaaatttgcatcccaattgtaacacttttaactatcttttttctgctatctatctgtgcttttcctgtttttatagactttagtgtctccgcatcatcactttagatatagcgttttcatacaattgggaaacaacaactttcctctggttaaaaaatatcactacactatcgccaataaaaagattttcaaccttgcttatgaataatcatcaaaagttgtggaactcgtttctctttttcatacccgatgaactccaacaatggcaaactctaatcttttatagtcatcgttagtttttgaggcgctgtttcggctcaaaaacttaaattgaagagttgttgacgaactcttttaagctggtcgagttctttcctactccccaaaactgccttgattaacgaatggctatctcttatgaatacagttttttagataaaaagaagtgagagttacataaaaactctcacttcactgtcaagttattgtgataataaaacaacttcacccaatattcttcaatatatctatcgccaaagtacaaatgaatctgttctcatagacaattatgaatttcttgacacctgttttgccaaagcaaagttcccaagagttgcagaaccattttcagcaacagctggcgttacgatatattctttgacatctggtgttgggagataatcgttcatcaaaccgacaaacttctcacgtacacgattaagcatgtgctcttgagccataactcctccaccaaatacaattacttgcggacgataaagcaaggttgcctgtactgctgcttgagcaatgtagtaagcctgcacatcccaaacgtctgaattgagctcgatcaattcaccacgaatacctgtacgaccttcaagagaaggacctgcaactaagccttccaaacacccattgtggaatggacacattcctttaaattcatgttttacatcgtaagggtgtagggcaacgtaagtatgacccgcttcggtatgacccaagccaccgataaactcaccattctgaatagcacctgcaccaatacctgtaccgattgtatagtaaaccaagctctttacccctttacgaaccagggtttcaccaaaagctgatgaattcacatctgtcgtgaagtagaatggaatgttaaattccttagcaatcagaccaagtaaatcaatatttgaccagtgtggttttggtgtcgaagtgatgtaaccataagtctgtgagttttgatcaatatcaattggaccgaaagaacctatcgcaatacctgccaaacgatcttcatagcgcttgaagaattcaactgttctctcaatcgtttcataaggagttgtcgttggaaattgcgttttttcaacaacttgaaagttctcatcacctactgcacaaacaaactttgtaccaccagcttctaagctaccatataattttgtcatttgattgtctccaaaatttttatcacttttattataacatataagcaaacagaagaaaaaggctgaaagcctttttcctgttaattatgtagtagagtcatgctctacaaatcgattttatataagattacttagctactttcaagaattctacaccgtgagcgattgttccctctgcaagtggagatacttctgcaaagtcagcagtgttggtcacgatgatcatggttgtatcatcaagacctgcttcagcaatcttagctgcatcaaatttagcaagcggagtaccagcttttactttatcacctgctgctactaatttttcaaatccattaccattcattgatacagtatcaataccgatgtgaattaaaagttcagcaccagacgctgttttcaatccgtaagcatggcctgtttcaaaagcaattgttacttctgcatctgctggagcgtaaacaacaccctcagatggtttaacagccaaacctttacccatagctcctgatgagaagactgggtcattaacattttcaagggcaacaacatcacctgaaagtggagatacaagagtttcttcgttgagctcaacagctggagttgcaggtgttgctactggagctgccgctgctttaggtgcagcttctacttcatcttcaaaaccgaagaggtaagtcaatgcaaaaccaagagcaaatgatacagctaccataaggatgtattggaacaattgaccattaccaacataaagtgtcgcaccaggaatgatggttacacccatacctttaccagcaagaccaagaagagatgctacagcaccaccgatggcaccagcaatcaatgaaagaagaaatggtttgcggaaacgcaagttcacaccgaagatagctggctcagtaataccgaggaaggcagaaagagctgctgggaaagcaagagctttcaatttaggatttttagttttcacaccaaccgctactgtagcagcaccttgtgctgtcatagctgcagtgatgatagcgttgaatgggttagcaccagtgtttgctaccaattgagcttccaagaagttgaagatatggtgaacacctgatacaacgataacttggtgaacaccaccgataaggagaccaccaagccccattggcaagttcaagatagcttgtgtaccagctaagatgtagttttcaaccacgtggaagactggaccgatgacaaacaaaccaagaatagacatgacaaacaaagtcacgaatggtgttactaagaggtcaagaacttctggaacaaccttgcggactgctttttcaaatttagcaccaaccaaaccgatgatgaaggctggcaatactgaaccttgcaaaccaacaactgggatgaaaccgaagaaaatggttggcttcacatcaccacctgaagcaacgacccaagcatttggcaattgaccagcaatcagcatcataccaagtacgataccgatagtttggttcccaccgaatacgcggaaggttgaccataccaccaaggctggcaagacgatgaaggctgtatcagtcaagatttgtgagtaaacgttcaaatcttctggaagagtatagccgagagctccaagaagaccacgaagacccatgaaaagaccagttgctacgatagcaggaatgattggaacgaatacatcaccgaaagtacggatagcacgttggaatgcattgccttgtttagcagcttcagctttttgttcaccagtagtcgctgttggcaaaccaagggcaaccacttcatcgtagattttgtttactgtaccagtaccaaagatgatttggtattgaccagagttgaagaaagcaccttgtactttttcgatgtcttcgactgtatccttgtcgatttttccttcatcaacaaccattacacggaggcgagtcgcacagtgagcaacactgcgtacgttctcacgtccaccaagggcgtcaatgactttttttgcaatttctgtattattcatcttgcaaaaatctccttattaaatattttttgttttttgaaagtgttttcaaactttcgatggttttattatatcacttttataaaatatgtcaaacgtttatcacattttgtttcaattttatcaaaaaacattgttaaaacttgatttttcgcaagaaaacgtttactatattaatgaaaaactagaaaatttggagaaaattatggcatttacaacaggggagcgttacagagcttatgctgactggacacccgaatacattgaaaaaataaagaagaatacagagagttctccttggaggacaaatttccatattgaaacaccacatggactgttaaatgatccaaatggattttcttattttaatggaaagtggactcttttttaccaatacttcccattcggtgctgcgcacggattgaaatcgtgggtccatacagaatcaacagatttggtccattttgaagaaactggtacggttatgtacccagatacaccacttgatagccatggtgcctactctggatctgccatggaatttggcgacaagctcttcctcttctacactggaaatgtccgcgatgaaaattgggttcgccatccataccaaatcggtgccttgatggataaagatggtaagattgaaaagattgataaagtcttgattgagcaaccagaagataccaccgaccatttccgtgatccacaaattttcaactataaagggcaatattacgctattgtcggtggacaaaatctggataaaaagggaattgtcaaactttataaagctgaaaataacgactacctcaactggtcctatgttggtgaccttgattttgccaatgatatgaccgcttatatgatggaatgcccaaatattgcgttcgtcggtgagcaacccatccttctctattgtccacaaggtttggacaaagaggtattggactatggcaatatctatccaaatatgtacaagattggtcagagtttcgttcctgaaacagcaagcattgtcgaaccgagcgaattgatcaatctggactatggttttgagtgctatgcaacccaggcctttaatgcaccagacggtcgaactctatctgttagctggttggcacttccagatgtggaatacccaaccgatgcttatgactaccaaggctgtctgtcattggttaaagaattaaccatcaaggacggtaagctctaccaatatccagtcgatgcgattaccagtcttcgtaaagaagctcagccattttcagcccaaaaagaaaccaataatgtttacgaattggaacttgatttttcagcgagcacgaagcacgaaatcgtattgttcgcaaatgaagcagaaaaaggcttggtcttgtctgtagacactgaacaaggccagattacattggaccgtggcaactgtggtcagccattcgcactcgatttcggcacaagtcgctcttgcgagatttctccaggagctcttacagccaatatcttcatcgacaaatctgtctttgaaatctttatcaataaaggagagaaagtattttctggtcgtgtcttccctgatgcggatcagtctggtatagtcattacgactggtaatccgaccggaacctactaccatttagattatggtcgcaaaactaactgatgtcgcacagttagctggggtcagcccaacaactgtctcgcgcgttatcaataaaaaaggatacctatctgaaaaaaccattcgcaatgtcgaagaggctatgcgtgaactaggctacaaacctaataatttagctcgtagtttgcaaggtaaatctgcaaaattagttggtctcatcttcccaacaataaacaatattttttattctgaattgattagccatttagaaaaagagctttttgatcgaggctataaaaccattatttgcaatagccagcacgagtccgataaggaacgtgagtatctagaaatgttagcagctaaccaagtagatgggattatctcgggcagtcacaatctcggtatccaagactacgaccgtgtcgtagctccaattatcgcttttgaccgcaacctatctccttccattcccattgtctcttccgataattttgctggcggggtattagctgcccaaaccttacaaaaagcgggatgtcacaatccattaatgattacggggaacgatgattccaattcacctaccggccttcgccaagtaggttttacatctattttgaacaaagccgaagtttttcatatctccagtgatttctcacctgtgcgtaaggagatggaaatccgagccattcttgaaaagcaaaaaccaaatggtatctttgtatctggcgatgcaacggctatgctggtatggaacgtcattcgttcaatgaaactgtctattccagaagatattaaattgattggttatgatggaaccagtttcatcgaaaactactaccctcaactgacaactatcaagcaaccattaaccgaaatagctcgcctgctggttgaactattagttgataaaatcgaaggaaaaaaactgacaaaaacagactatatcctgccgattagcctactagcaggagctagtatataaaaaaagctgtacctaataaaaattaggtgcagcttttttgtgatacattctcttatttctcaagtaaaaaagaagctcatcaggcttcttctttaataaactggctcaaaactccattgacaaacttagctgaagattcatcagaaaattctttagccaattcaatagcctcgttaacagcaacgcggtctggcgtttcttcgaaatgtaagatttcaaataggcctagtcgcatgatattcttgtcaatcaaggttaaacggtctaaggtccatcctgcttttaatcggctagataactccttatccaagtcatcacgatagtctgctacaccattgacaaggttaaggagaaagagcggaatttcaactccttcttgctcttcttctctatcataaagataagaaaactgagctgcctgaacaggttcttgaccaaattcaagtgatacgattgcctgcaaagcacacttacgcagggcatgtctattattcttcatcaaggaaatcctctccgaataaatctttcaatgctggttttggtgttttatcaggaacaatgccgctgacatggatattaaccgcagccacttgaacttctgcatagttataaactgctgtcttgactgcacgttggatgtccattgatacggcaggaacatttacaccatattctagatagacgtaaatatccgcagtcactcgaccttcctcgtcagtttcaagataaacacctttatttaacgatgtttttgaccaactgtctgctacacgcttattttgaagggaatgcactccatcaactttcgctgcagcaatgcctgtaattacttcaaggacgcgaggtgcgataacaatctcgccttgatattctgttgtcataggctctcctttcttaagaggaaacgattaagcacgtgatacgtaagttccttcagctgtgttgataacgagtttttgacctgcttcgataaagtctggtacgttgactacaagacctgtttccatcgtagctggtttacctgaacctgtaacagtcgcacctttgatagatggttgtgtttctgcaacgaccaattcaacagttgttggtacagtaacaccgatcacttctgttccgtagaactggatcttcacttcagaattctccaagatgtagagcaattcttctttgatagtcgctactggaatttcatactgatcgtaagtctcagtattcataaaataagctgtgtcatccatttggtaaaggtactgtgctggaactgtttcgataatagcttgttcaaatttttcatctggacggtaagttgtatcgaaggttgaacctgtacgtacatcacgcaatttcatacgcatgatggtgttacctttacctggtttgtggtggctcgcatccaaaactttaatcaatttaccttcagcttcgaaggtcatacctgctctaagtttacttgcttcaatcattgtattgaatacctcttcaaattttatttattcgttttattctaccacaaactgtcaaatttctcaaatgacaatcaattccttgggagctaatgtcaagacttcacaaccgttttccgtaatcaataggtcatcttcgatacggacaccatatttgtcatccaaatagataccaggctcatccgtcaaaaccataccggccttgatagtctcgtcagattttccaaaatacggatattcatgaatatccaagccaataccgtgaccgatgccgtgtgtaaagttggctccgtaacccgccgcactgataatctcacgaggaatagcgtcaaactcgcggtaggtgacaccttccttggcctgctcaatcaaagccttattggcacgcaagaccacatcgtaaatctcacgctcttgatctgtcacatgaccgatatggatggtccgtgtcatatcgctgacataatgctggtaatagcaaccaaaatccagcgtcaaggtctcaccagattggataaccttttcagacgctcttccatgaggcatagcagagcggtagccagatgccacgatgaactcaaatgatgccccttctgcaccgagttgacgcatgcggtggtcaaggaaatgattgacgtccatctcagtcgtctgacctggtttgataaagtcaagaacatcaataaaagcctgatccgaaatttgacatgcacggcgaatggtcgcaatttctttctcatccttaatcatgcgcaagtcttcgataaagtttgacatagcaaccagttgataaccctcaaaaatgctggtcagactttgatagaaaccataggtcacctcgctatcaaaaccaattttttcaagcccatcttccttaatcacctttgcaatttcttcaagggcaaaacggctctcgataatatcaaaaccttttactgatgccttggctatcaaggtataacgcgaatcagtcacaaacaagcgacgcttgccactaatgaagacagtcgcctctgtcccccaaaaacctgtcaggtagtaaatattgttttgaccagttaccaagattccatcaacagttgattgagctaattttgcttcaaatttttcaagtcttttttgcatcctattcctccaatgattttttaactattatagcagaaatacagacaaataccaattcttcctagcagatagagaaaaaaagccgcagaggcgactttttatttcaacttcattttcagatactggcctgtaaagctggctgggttctccgccacttcttctggtgttcctgtcgcgacaacggtaccgccaccgacaccgccttccggtcccatgtcgataatgtggtcggctgtcttgataacatccagattgtgctcgatgaccagcacggtattgccatcatcaacaaagcgagccaagaccttgagcaactgggcaatgtcctccgtatgcagacctgtcgtcggctcatccaagatatacaaggatttaccagttgaccgcttgtggagttcagaagccaacttcatacgctgggcttccccacctgatagggtcgttgctggctgacctagagtaacgtagcccaaacctacatcttgaatagtacgaagtttccgctcaatttttggaatatgcttgaagaactcgaccgcgtcattgaccgtcatatcaaggacctgagcgatatttttctccttgtagtgtacttccaaggtttcagaattatagcggtgtccatgacagacttcacaaggtacaaagacatcgggcaggaagtgcatttcaatcttgataatcccatcaccagaacaagcctcacaccgtccacctttgacgttaaaggagaaacggcccttcttgtagccacgaatcttggcttcattggtctgggcaaacaaatcccgaatatcgtcaaagacacctgtgtaggtagctgggttagaacgtggtgtccgtccaatcgggctttggtcaatatcaatcaggcggtccaagtgttcaattcctgaaatagacttgaacttacctggcttgtccgaattgcgattgagtttctgagcaatagcttttttcagaatggaattgaccagagttgacttacctgagccagacacccctgtcaccgctacaaattttccgagtgggaaacgaacagtcacatcttgcaggttgttttccttggcaccggtcacctctaagaatcgaccatttccaacacgacgttccaaaggaactggaatttcacgtttgccagacaggtactggcctgtaatggatttcttgtttttagctacttgggctggtgtgccagaggccacgatttctccgccaaacacacccgcacctggaccgatgtcaatcaaccagtccgcctcacgcatagtgtcctcatcatgctccaccacaatcaatgtattgcccaaatcacgcattttcttaagactagcaatcagacggtcattgtcccgctggtgcagaccaatcgacggctcatccagaatatagaggacaccagacaggttagagccaatctgagtcgccagacgaatccgctggctctcaccaccagaaagggtacctgctgctcgtgaaagagtcagatagttgagaccaacgttatttaggaaggacaggcgatccttgatttccttgacaatgggtgttgcaatggtggcttcattttcagacaaggtcagatgttcaatgacttgcaaatgatccgccacggacaagtctgataattgtccgatatgaagtccctgctcgcctccgactttgacagacagggcttggtcattgaggcgatagccgtggcaggtcccacaggtcagttcattcatgtaagtcttcatgactgtccgtgtgtaatcactattggtttcacgatagcggcgattaatgttggtaatcaagccctcgaatggaatgtcaatatctcggactccaccgaactcattttcataatggaaatggaattctttcccgtcagaaccgttgaaaatcaggttcttctcctcttccgtcaattcctcaaaaggcttgtccatgtccacaccaaagtgattcatggcctgctccaacatctgaggatagtagttggatgagattggattccaaggagccaaggcaccttcacgcaaggtcttgctggcatctgggacaatcaaatccgtatccacttccagcttcatgcccaaaccgtcacagtcgctacaagacccaaaaggagcattgaaagagaagaggcgaggctccaactctggtaccgtaaaaccacaaactgggcaggcatagtactcagagaaaagcatttccttctcatccatggtgtcgatgatgacatagccgtccgcaatccgcagggccgcctcaatggagtcaaaaagccgcgagcgaatgccatctttgatcacaatccgatcgaccacaacttcaatattatgagccttgctcttggacaattctggtacttccgacacatcatagacaccgccattgacacgtacccgaacatagccgtccttctggattttctcaaaaatggtcttgtgttgcccctttttcttacgaacaatcggagctagaatctgcaaacgttggcgttctggcaattccaagacctcatcaacgatttgttccaccgaagaagccgcaatcgctccgtggccattgatacagtaaggtaccccaacccgagcataaagcaagcggagatagtcattgatttccgtcgctgtaccgactgtcgaacgcggattccgcgatgtggttttttggtcaatggaaatagcagggctgagaccctctatggaatccacatcaggcttgtccatgttgcccaagaactgacgagcataggcagacaaagactccacatagcgacgttgaccctcggcatacaaggtatcgaaagccaaactcgacttaccagaccccgacaaaccagtcaccaccaccagcttctcacgcggaatggtcacatcaatatttttcaaattatgggcacgcgccccatgaatcacaatattttcttgcataacatgatataagtgcgttaagaaagcgataagaaaataggaaaatgtgacgtcacatcagtgacaaaacattttgtctttttctcgacgcttttagcacgcattcgaatcctttctaagatataaagagcatcaaatgcacagtcaaaataggcggtaagtccgaattctgtgatttcgaagatgcacccccttcaagacaactagtgctttcacaggttgaaaaccgaagaaagtacagatgtctacgacgcagaaaccagttcccatacttatccatgaagaaactagcactttttgacaccgcatttagcccgtgttcaattcctttcttaagaggctataagctatggtatacggaacaaggaaaagtccgtacaacttattcgcttaaatgtctacatattatatcacatttctatataaaacctttccgaaactgcacattttttggtataatagaggttgcgttaacgcaacaaagataaaaggagggcaaagatatgaaacaaatttttctatcaaccatgactgatttagaagaaatccaaacctttgaaccaggggcttggattaatttggtcaacccctcccagagcgagtctatggaagtggctgagcactataaaattgacatcgctgacctgcgagcaccgctcgatgcggaagaatcctctcgtatcaccgtcgaagatgactatacgctcatcctggtcgacgtcccaattcttgaagaacggaacaacaagacatattatattactattcctttgggaattattctaacagatgatgcaattatcacgacttgtttggaaccattgccactgtttgagcagtttatccatcgtcgtctacggaatttcttcactttcatgaagtctcgtttcgttttccaaattctctaccgaaatgctcaactctacttgtcagccctacggaccattgacagaaagagcgaagagattgagaagcaactccatgaagccactcgaaatgaagaattaattgtactcatggaattagaaaaaaccatcgtctacttcaaggcttccctcaaaaccaatgagcgtttggtcaaaaaacttgctagttcctcacgcctactccgtaagtatgaagaggatgaggatttgcttgaagataccttggtcgaaacccaacaggccattgagatggcagacatctatggttccatcctgaactctatgacccatgcctttgcttctatcatttctaacaaccagaataccatcatgaaaaccttggcattagtgacaatcgttctctctatcccaaccatggtcttctctgcatacggtatgaactttaaggacaacatcattccttttaacgatattccctatgctttttggtggattatcctcttcgcatttgcaatcagcctatcactcaccttctacttcatccgtaagagatggttttaaactaaggagattaacatgtcatttacagaaatcaacggattaacaaaaaagaaccaagaatttatccatattgcgaccaaccaactgattaaagatggaaagtctgatagcgaaatcaaagaactcttggaagaaattttaccaactatcattgaaaagcaaaaaactggtgtgactgcccgcaatctctatggagcaccaagtgagtgggctgctagtaagacaatttctgaacaggaaaagaaagaccaagtggaatacaatgaaaatccatggttgatgtggctagattctagtcttttcatgcttgcaattattgctggtatcaatggtttgatgaatctttttggtcaaggtgcacagtatgggctattaaccttatttgtcatcggtttcggtgttggtgcagggatgtacttgatgtaccatttcgtttacagagaacaaattaaaactgggcaacgtcctaaattgctgaaagctatcgcttttctcggacttgctacgctggcttggtcagtcgttttcattctggcagcactgattccggccgcatttaacccggttcttcctccgcttgttactattcttatcggagctgctgctttcggtgcacgctacctcttgaaaaagaaatataacattcgcaatgccatgtccccagttcaataataaaacaaagcgattggaatattccagtcgcttttgtttatctatacagttcagctatcaaatcgcccgagaaccttatccgctgtcacttgtctatgtaatctgctgaaacagtctatccccagactgtgcctcgctttctaacttcttggctcgggttgaaacagtccattcaaaggcttaattcgctttcttaatttcgagttcatgaaaaaatggtccactctcgccgttgcgcctttccagtttcttgggcgcaagctaaaaagacccgtcggggtctcaattcgctttcttattttcatgctcatgaaaaaacagtccattctcgccgttgcgcctttccagtttcttgggcgcaagaaaaaatggtccactggaccatttttttaatcttcgtttacgaatggtaaaagagccataacgcgagcacgtttgatagctgttgttactttacgttggtttttagctgaagttccagttacacggcgtggaaggatttttccacgttcagaaatgaaacggctaagaagctcagtatctttgtaatcaacatattcaattttgttagctgcgatatagtcaacttttttacggcgtttgaaaccgccacgacgttgttgagccatgtgtgttctcctttatattattaatttttgacctagaatggtaggtcatcgtctgatatatccattggattacttgctccaaatggactttcttctcgagcgaagtttggtgtagattgtgcaggcgcttgataaggcgagttatagtcatttcctccagcaaacgagttgccagctgaatagcctccaccttgaccttcacgggcagtacggctttccaagagttggaaactttctgcaactacctcagtaacgtagacacgttgcccttgctgattgtcatagctacgagtctgaatacgacctgtaacaccaatcagagcacctttcttagcccaattcgccaaattctcagcttgttgacgccaaatgactacgttgataaagtccgcttcacgctcaccgttttgatttttaaaattgcggttaaccgccaaagtaaaagtcgcaacagcttgattagacggagtataacgaagttctgcatcacgggtcatacgaccaaccaatactacattattaatcatacaacaccttcttacgcgtcaagtttgacaatcatgtgacgaagaatgtcgccgttgatttttgacaaacggtcaaactctttaagagcttcatcgttgttagcttcaacgttaacgatgtggtacaaaccttcgcggaaatctttgatttcgtatgcaaggcgacgtttttcccatgcttttgattcaacgatagttgcaccgttgtcagtcaagatagagtcaaagcgtgctaccaaagcgtttttagcttcttcttcaatgtttggacgaataatataaagaatttcgtatttagccattgatatgttcctccttttggtctaatgactcatggtctagccacgagtaagtgagggatactcacagaaaataattataccataatatagaaaatgtgcaagtgaaaacaattttccgaaaacattttcacaaaaaagtaaattcccaaagtaagttctagtctgtcttaaaaactggaaattagactgagacaaagaaataaggtagaacttactatgggacaagttggtaactgacaatgaaaaacaaacacttaactctctctgatcgcaatgatattcaaataggaattgaacaacttaagcccttctcagctatagcagctaagttaggaaaagatccgtccacaatttcaaaagaagttcggagaaatagggtgataaaagagaactctagtacctccaattgtgaggcttgccctctactcaaaaagactccttacgtttgtaatgcctgtccgaaaaagagaagcaactgcggataccagaaacagttctactacgcaaaaagagctcagcttgattatgaagttaagctctcagattcgagaacaggtgttgcactaaacaaggaagaattctatcgcatggatgagattgtttctgctgccatccaaaagggacaacacctcaaccacatcatcgcctcaaacgaaatgtcggcatccagagcttctatctaccgataccttgaaaaaggctatctgtccacaaagcccattgatttcccccgtgtcgtgaaattcagaaagcggagaatcagaaacctacaacccattcctaaaatcgccaaagaaggacggtcttacgaggacttccaacgctttctcacagagaaaggaatcagctattggctggaaatggacaccgttactggacggatcggcggaaaggtacttctcacctttaacctctccttctgtaactttatcttcgctcaattacttgataataaaacagctaatgaggtcgctaaacatctctacgctatcaagaatgacctgcatcagaaagagatggacttttgcgaaatatttcctgtcattctgaccgataatggcggtgaattcgctagagtggacgatatcgaaatggatgttcgcggagaatctaagctattcttctgtgaccccaatcgttctgaccagaaggggagaattgagaagaatcacacacttatcagagatattcttcctaaaagaagttcttttgacaacttgacacaggaggacatcaacctggtttgttcgcatatcaacagcgtcaaacgagcttctttcaacggaaaatcagcctatgaactctttacatttacctacggtgaggaattggcaacacttttgggaatctctaaaattgaccctgagaacgtcattcaatcacctcgattattggataagtaatcgctagtttttatcaaaaaataatttcaaaatagaaaggaacttgttccatccaaaattccagatagctagaacttactttgagacgtctcagagccagtaactttagtgtactcttttttcaacattttcaaccctaaaactcactattatcaacatttttagtcaaaaacagaacttagtctgagactaaattctgttgatgttatgcagttttctcagagtaacttctggaaggacgggaactagaacttactttgagaatttaccattttcacaaaaaataaagactgcccaaacaaagggcagccctatgaattaagctacaatcgcttttgcgacttcttctgttgtcatacgcgagaaataatgagtagtatcaatctcttgaagtttagcaagtacatccgcatattcataacgtgtaccaactagtaagtcttcaacatcagctacatccccaataccgaagaagtcaccgtaaatcttgatggattcgatgacagatttttcagccttgatataggttgtgattttaccagccgggtaacgaacgctgcgctccacagtgtattctggtgtttgaccgtaggtccaatcccatgttgcaaactgcgaatcacggatttcttggattcgagccaaatcatcctcagtcaacacatattcatccatttctggatattcttgcttcatttggttgaggatggcatccttgaactccagaacggtcatcttatctggcaactcgttgttaatgttggtcacacgggcacgaacggatttaacacctttggactcgattttgtctttgctgaccttgagggcacttgcgaggactgacatatccacatcaaagagcaagcaaccgtggtgcatcatgcgacctttggcataggcttgggcgttaccacagattttctttccgtcgatttccaggtcattacgaccggtgaaattggcctctacacccagtgttgcaagggtatcaatcacaggtttggagaaggttttgaagtcaaaggctccctcgtctgccttatttgaaataatagtatagttgaggttatttaggtcgtgataaactgcgccaccacctgacagacggcgaacaacatggatgcccttttcgtctgtgaattccttgttgatttcttcaatagcattctggtgcttaccgataatgatggcaggctcattgatccagagaataaaaatttcgtcaatatctgttaattccttgaaggcataggcttcgagggcaatgttataagctgggtcattgctgttatttacaatgtatttcatgcaaaactcctttattgttaactaatttttattatagtggaaacgataacaaaagacaagtattgaaactcttcttgtccattcttgaattttctcaaaaatgatggtaggctataaaaggaggttttcatgagcaaacacttaaaatcatttttgatcttttatctagccgcaagcatctttcttccttttatgtggtttatcaatgcgccacttatctgctttgtacttcctctttatctgacctggaaaaacatccgccatttttgggaccttttgaaaaaacagttaaaagagtatagtttttggattaacgatggtttgattttctttttaggaacagggctaagttggttggctcttgaaatggctcaagttgtttacgtcgattggccagaaaccttggttaataaccagatccacagcccaatgcagaccgaagcctggtcagggcagtttttcctactccttttgggtgttttagcttatttggtgctaaacatcttccaaactaagctcctcccccctctcctaacggtcctcctcatcagctgcctatatccaagttttgtctttgctgttttgtggactatacaactttctagtttgattgaaacagatttcttcacctactgctacctgtgtttggttcctttcaatatttgtctcatttacagtcggacaattttacaaaccattcaactgtggcaagcagaattagccaagcagagcaacccacgctttcctagactttctgctctcctgcaaaaaagcctttctctgccaatttggctcctcttcttcagtcttccctatcttgcagttcttggctcctatctcattctctttggtcaaaaacctgaccagctacttcagatgtggacggaaaccagtgattgggccttgtcggaaaaaatctccccaccaaacgcattctatgatgaacactatctttgtacagtgggggctgctggtcaccgtaaactggtcaaacccattcgtatgggggaacgccatggacatcgtgtggtggtcaatcgtcagctacaaattgccaatgcttttgaacaaattttagaagaaagatgtccacgcctgcatcgttgcgttcgttccaactacgaccggtatggctatcccatttccaaacatattcgcaaagcttggcaggcggatctgatctatctgatcatgaaaccagccgaatggctcttcctcatcgtcatctatctgcacgatcgtcagccagaaaatcgcattgctgttcagtatttgccgctatcaaaaaatctattaccacaagaaaatactagcaattagtaatatatcacaaaaaagaaagccacatggactttctttttgcttagcttattatttgcgttttggtgggttgtggattgcaacaccaagaacatcaagaaaggcttcatacataacctctgagaaggttgggtgaccgtggattgatgctgccacatcatcaacagtcaattcagattccatgatagttgctgcttcgttgatcatttcagctgcaactggaccgatgatgtgaaccccaaggatttcatggtatttcttatcagcgataacttttacgaaaccatgggcttcgttagaagcaatagcacgaccgttaccagtgaagctattgcgaccgataaggatgttttctttaccgtatttctcgatagcttggtcttctgtcaaaccaaccatagcgatttctgggtgtgtgtaaaccgctgctggtgtgaagtctaatttagccttgtggtggttaccatggatggcattttcagctgccacttcacccatacggtaagcagcgtgagccaacatcttagtaccgttgacatcacctggtgcgtagatacctgggattgatgtttcttggtattcgttaaccttgatacgaccgcggtctagttcaaggttaagattttcaagaccagccaattgtggtacacgaccgattgaaagaagggctttttcagaaacgatttctgagccgtcattcaacttgattgtcaattggttgttggcttcgacgatttcagatacaccaacagatgtcaagaatttcatacctttcttagaaaggactttttgcaattcaacagacacttcgcggtccatacctggaatgatacggtcagccatttcaacaacggttacttctgtgccgtatgatgcgtaaaccaaaccaagttctacaccgactacgccaccacccataacagtaagtgacttaggaatttcacgcaagtcaaggatatcatcagaagtcaataccaacttagaatcaatacctgggatattgatgcgtgatactttagaacctgttgcaaggatgatgctacgacctttgatgaccttgtcgccgatgacaacagtcttgtcaggattcacttgaccaagaccgttgaagattgttaccttgttagctttcaagagaccttgaacgccaccagtcaatgtcttcacaaccttgttcttgaagtcaactgtcttgtccatatcaacggtatagtttgttgaagcaaggttgataccacgctcagccgcaatcttcaagccgtcaaggatttcagcgtttttgaggtaagtcttagttgggatacaacccttgttcaagcaggtaccgccaaattctgatttctcaacgatagcgattttaccgcccaattgagcaccgcggatagcagcgtagtaaccagcaggaccaccaccgacaacaaccatgtcatactcgtctgctgccaattcagccttaggagcttgtggagctgctgcaggtgttgcaggaacttccaaaccagctgctttcaagtcagcagttgcttgagcaacctcagctggagctagtgcagcacccacttcaactgattcgccttctgcaccaaggtaggcaatgacttctgttacaggaactgttgcaccgttgccatgaacgattttcaaaagaacacctgattcttccgcttccaattccatacttgtcttatctgacatcatctccaagataacatcgccttcgttgacaaaatcgccctcttgttttttccactcgatgatttcgccttcttgcatatctacaccaagtttcggcataataatttcaattgccatagttaagataccaagagcgaagagaaagcgactgaaaaataggaaatcgtagaaaatcctgattttctaaacgatttatcttttttccgagctttccgctcgggttcaattgctaaaactctctcgctcttattccctttctttattttttctctttaccaaattgagcacaggctaaaaacctattgaaaaagataaatcgcctcgtgcctcaaagcacatcgttgatttcctattttcatacgtttttcttaacgccttttgcatcttatctcagatcaacaattccaatgggttttccagcaagttcttcaagtcaaccatgaacttagcaccattcataccatcaatgatacggtggtcgatggttaagcagagtgccatgattggacggatcttgatttcgccgtcaataacaactggtgtttgaacagttgatgctacaccaaggattgctgagtttggttggttgatgattgggttaaaggttttagtaccaaacatacccaagttggtgatagagaaggtcgaacctgacatttcagcccccttcaacttaccagattgagccttcttgatgacatctttcgaagccaccacaaagtcagacaagctcatcttatctgcgccgtgaacaactggaaccaccaagccatcatctagacccactgcgataccaaggttgacgaacttgtgtaattcgatttcttgtgcatcgttaatcaaagatgcgttcatgtaacggtgttcttctttcatcaaagtacgaacaaccgcaagaccgatcaagtctgtaaaggttactttcaaaccagtcttgttcatgattggctcaaggacttgcttacgaagtgccatgaggttggtcatgtcaatatcgtagttaagtgtaaatgtcggagcagtcaagtaagagttgaccataccttttgaaatcgccttacgcattgggctcatcttgatgatttcaacgccttctggcaattctttagctggtttttcttctgcttttggtactggagcagcagtttctacagctacaggagcaagtactgcaagaacgtcgttcttgacaatcttaccgttgacacctgaacctgtaagggttgacaagtcaacaccttggtctgctgcaatacgggctgcaagcggagttgcttttggagctgctcccttgaagtcttcgacgtcaaccttgtggacacgaccgttagcacctgttcctggaacaagacccaagtcgattccaagctcacgcgccaatttacgcgcagctggcgttgcacgcaccttgccactaccttgtggtttggcagcagttgcaggagcaacgattactggtgtacgacccgcaggtacttcttcaatagccgctgctggttcaacagcaggagcagatgaagcgccggcttcaaccgtttcaccttcagcaccgatgtaggcaataacttctgttacaggaacggtagcaccgtttccgtgaacaattttcaataggacgcctgactcttctgcttccagctccatgctggtcttgtcagacatcatttccaagatgacgtcgccttcgttgacaaaatcgccctcttgttttttccactcgatgatttcaccttcttgcatgtccacaccgagcttaggcataatgatttcaatagccattattaagataccaagtccgaacagaaaacgaatgaaaaataggaaatcgtagaaaatcctgattttcgtaacgatttatcttttttccgagttttccggacgggttcaattcctttctttcagtttcttaccttgtcaagaaccaaaccagacttcgataatcgaagcggctcaattcttttccaagcattcttagtcatgctagaacattttatttctagcatattagggttatcgtctttccgattgcttttctgacaaggcgatttggtgcaggcataacttacgttaggcaagccaaatcaacacagccagaaaagataagtggatgacgataaaattaacccttgtttacttgcttatagattgccgctttgattttctctacgtttggcaatactgcgttttcaagaatgtttgcgtaaggaactggtacatcgtctgaagcgatacggatgattggtgcatccaagtagtcaaaggcttcgctttctgtgatgattgatgcgatttcaccgatgaaaccacctgttttgtaagcatcgttaaccaagataaccttaccagttttcttcacagattcgatgatcaattctttatccaatgggataagggtacgtgggtcaaccacttctacgctgataccttcagcagccacttcttcagccgctttcaaggcacgttccaacatacgaccgtatgaaataatggttacatcagtaccttcacgtttgatttcacccttaccaagtggaatgtagaaatctggatccaagttcacttcttcttttttaccgtaaagagcttttggctccaagaagataactgggttgttgtcaaggatagatgatttcagaagaccttttgcatcgttagcagtaccaggtgcaaccaccttgatacctggaatgtgagtcaaccaagcttcaagagactgtgagtgctgtgctgctgaaccgatacctgaacctgaagccacacggaaagttacaggtgttttcaaaccaccaccaaacatgtagttggttttggcagcctggttaacaattgcatcaagggcaattgtgatgaagtccatgaaagtcaagtcaacgattggacgaagacctgtttgagctgcaccaaccgcagaaccagcgattgcagcctcagagataggcgtgtcgcgaacgcgttttggaccaaactcgtccaacataccaacagatgtaccaaagtcaccgccgtagataccgacgtcttcacccatcaagaatactttttcatccttacgcatttcttcgctttgagccaagttaatcgcttcacgcaaggccattacttttgtttcagccattttttactcctaatttatatcaatttatctatactgaactaaggaaaaccaaacaattactacgatgtaattgtttattgtcccagcttaagacaccttagaattgtactcgaacttgagtaggtagtccaccctagtttgacttgctatttagagcttagtcaaacttcttacgtttgtagttaggttctgactagaggcttggaaaaatagatgagccattagtgatgtccacatcactagctgactctctaatttttctgtgcctctttaacgtcctcacaccctagtctacaaacacatcctcataagctactgagatgtctggatctgggctttcttgtgcgaatttcacagatgcttctacttgttctgcgacttgtgcttcgatggcatccaattcttcgtctgtcgcaatcttgttttctgtcaagtatttgcggtatttcttaagtgggtcttttgctttccactcattgacttcttctttagtacggtaaacacctgcatcggcagttgagtgaccaaaccagcggtatgattcaacttcgaccatggctggacctttacctgcacgaacgtactcgatgacttcttgcattttttcataaacagcaataacgtcgttaccatcctcaacataatgacctggaataccgtatgcagcagcacgttggtagaggtgaggaatcttagtagaataagaaatgtcagttgaaataccgtaacggttgtttgtaatgaagaagataactggcaagttccaaacagctgccaagttcattgattcgtggaaggaaccttcgttagtagccgaatcacctgagaaggcaataacaatgttatctgtaccgaggtattgttgcgtaagggccgcacccaccgcaagggcataaccaccacctacgataccgtttgaaccaaagtttcctttttcaacgttagccaagtgcatcgaaccaccacgacctttagatgtacctgttgccttaccagcaagctcagccatcatgccgttgatgtcaataccttttgcaataacgtgaccgtgaccacggtggtgtgagaagatgatgtcctcatctgtcaatccagcaataggtccaacagccgcagcttcttcaccgactgagaagtgagtcataccttgtacgaaaccgcgacgcactaatttgtttaatttcatgtcaacatcacggatttgttgcattttcaagaacatgtccaaatgttgttcttttgtgatagataccataatttcctccaaaggtttttctctttctgtactatgatagaccaatatttcacaaatggcaagtaattgaaccgttttctttttacagaaatttttgtgaaaaccttgatttagtgcgttttttcacaaatcattaaaagattcactttacttgtttgaaacttttttcacaaactttgaaataagcttgcacgccgtctttctttctgttaatataggtacggaggttcttatggaattcgatttatttcttatgatttgtaactacataggcactatcgcatttgctgtttcgggggccgtaaaaggatttaagaaaaagttagatatttttggaattagcttgctcggtatcattaccgccgttggtgggggaattattcgagatacgatggccaatcgcattcctgccgccttgactgatcctacagccatctatttatctctcggagtagcgattagcatgtacttgattgttatcaatctaaagcaggacaaaccacttgataagaagatgattcatttcctttcccagacaaaccttatctttgatgcgatcggtctagccatcttcgccctcattggagccagtactggcatctctctccaactaaacgctctaaccagtggtattctggcagctttgacaggtgtcggaggcggaatcacccgtgatttactcgtcaatgaaacacccattgttcttaaagaagatgtctatgctgtccttgcatttttctctggagtcctctatcatctttgcgttgtaaattggaaattaccacaaattccaaccttcatcactatttttaccatttctttaatcattcgattattggtaattaaatacaaaatcaatcttcccaatatggaaagcaaacgaaaggtctgagttcgtcaactcagacctttttgtattattattgattaccagccaccgtggccaccagcacctggtcctgttgctgtgatttgagtaatctgctcaccgttaactgtcacagtacctcctgtcaattcagcagttccgtcgaagtcaaaagcagattgagctgttacatcaattgtaccacctgagatataaatgtctccattagcatcaaaggcatccgtatctccactacctacagctactttcaagtcaccgccagttaccttgatgaagatttctgatgatgttgtacttgccgcattaatagcatcatctgaaccatagacatctaatgtaccaccattgatagtgatattagttccttccaaggcttctgctgattctgatactgtaatggtacctccgtcaattgtcaaagccgtctccgctttaataccatcatcacctgctgttacagtaatttcaccacctgtgatagttgtataacctttggtagtatctgtatcatttgtagacttgataccatcaccacctgctgttacattgattgtaccaccattgattgtcaatgaatccttaccacggataccatcatccactgcagtgacggtaatatttcctgaattcacgacaaggtcatctgtcgatacgatgccatcttggaagttgccttcaacggtcaggctaccattaccagtgatggtcaaatcagcttcaacatggatagccccttcaatattggtgtctgtatgattgctggtatctttcactgtattcgtcgtaccatctttgatttccaattcaacattgtcagcattaataacattgattgctgctgtatctgaacttgaaatctcagcacctgctagaatgatgcgaacattggcatctgtttcaaccgttacaccagctgttgttgaaccagttaaaatataggttccaccctcagtaattttcaagccatcatttgaaagcttcacttctgtcgttggaagggctgaccagtcaatagttgacgaacttgaatctgatgaagtgctattatttgaagttgtcgctacacttgtctgactagttgctgctgagcttgaagtagtcgttgaacttgaagtagatgaacatgctgctaagacaccaaggctcataagagtaacaccagagtaaagtaattttttaagatttgttttcataatgtagattccttttctttaggaagtcgtatcccttcctgatatgctcctagtttacctttccttcctaaaagaaagattaaagattgccaaaagaaaacttaaacttcttaggaactacaaaaggccgggaaacccagcctaggaataatcattgataaaatctatagcttaacccaatgcaagcttttcaactcaagcaagggagaagtttcaggattggtatctgattcagaaatccgttttaaacctggaatcatcgcattgtattgataaatgcgaaaaacaccagctccttcaaataagtatgttccatcctgtaaaggacgaagtagggcgtccggtccaatttcaaatccaagattgcggaaattatccaccaaacgtagactctcatcggcaagctgagtataaaggtcaattaagacatattctcccgacttgtccaaagctagaagcagctcctctgtaccatcatggttaacatcatacaaactataaaatattccactgtattcttgcccctggctagttaataagctcagatagctactggcctcatcctgattaattgcctcagcaggctgacccatattcgcttgataacgatcaataactgattggtatacttcacttagctcaggagtggtcactgaggatgcttgcgtctcggagctagatgctattgttgacgcttgctgcaaactagaaccatctgaaacttggcttgaagcactagaactagaactctcaccaccttttacctgattagactgacaagcagctaatagtacaaccgtggacactaacatcagtttactaataaatattttcataacttcctcctgtgctctatctttggtcttatactcttcgaaaatcaaaattatccgttgtcaacttgccttgatgagtgaaaagctccagtggaggttttcagcctgttaccatgaaataagatagtaacagagttctatcttcgacttcgtttcctagtctacttttgattttcattgagtattagtataacatctttccgagggcttgtaaacgccaccatatatggacaaagcatccgagccagaaaaagccgaatgttgccatccgacttttgttgttaatctttctgatcaagagcacgcaacatttggtcaattttattgccgtactcaattgattggtctttttcaaagaccaaatccggaattttataaagagttaacttacgaccaagttctctcttaatggttcccgtcgctttttcaagacccgtttgtgctttttgattatcggatgccaaattactcatgattgtgtaataaaccttggccgttgacaaatcgccgaccatctgaacatctgtaatagtcactccctgcacacgtggatcacgaactttcttttgcaaaatctcattgacttcgcgcttgatttccatcccgacacggtctgtacgaaaatgattcgccatattctttcctttcttagatgatagaaaagctgagtttccccagcttgaataatccaagtagattaaaaactattgctttaaaacctactaaaatctattaaattgtcacttcctcgacaaaatcacttgtctatgactttgacagtgagaaaatattattttttgatttcttccatgatgtaagcttcaatggtatcatcaactttcaagtcgttgtagttctcaatcatcaaaccaccctcttgggcattaccaacttctttcacgtcatctttatagcgtttcaaactagctagtttaccatcaaatactacaacaccatcacggataactcgaacacttgaatcacgggtaaccttaccacgtacgaccatgaaaccaccgattgttccaactttggataccttgaaggtttcacgaatgattgcctcaccaatgattttttcttcatattctggatcaagcatacctttcatggcatcttccatctcttcgataaccttgtaaatgatgctgtgaagacgtacttcaacatcatctgcttcagcttggctacgcgcttcagctgttggacgaacgttgaaaccaatcacaagagcatttgaagcttccgcaagagtaatatctgattcattgatagcaccaactgcagagtggacgatattgacacgtactccctctacttcaatcttttgaagcgatgatgcaagagcttcaacagaaccttgtacgtcggccttgataatcacattaactgacttaacctcacctgctttaagggtatcaaagaggttttcaagactaactcgttgcgttgcttgacgctgtttaagaagagcacgtttagcacgttcttcacctgctgcacgagctgatttttcatcttcataaaccgcgaaatggtcgccagccattggcgtttcgttcaaaccagtaatagataccggtgtagatggaccagcagttttaacacgacgaccaaggtcatttgtcatggcacgaacacgtccgaaggtatttccgacaacgattgggtcttgaacattaagtgtcccttgttgaacgaggagggttgcaaccgcacctttccctttatccaaatgagcttcgataactgtaccaatcgcacgaacagttgggtctgccttcagttcttggatttcagcaaccaaaagaacagtttccaacaattcatcaatgttttggttaaacttagctgagatttctacaaattcagattctccaccccaagcggttgagataacaccgtgctcagccaattcaccgatgacacgctctgggtttgcacctggcttgtcaatcttgttgatagctacaatgatcggcacattagctgcttttgagtggttgatagcctcaatcgtttgcggcatgacaccatcatctgctgcaacaactaggatggtcaagtcggtaacagatgcaccacgtgcacgcatagaagtaaaggccgcgtgtcctggagtatccaagaaggtaattttcttaccagcttcctcaatttggtaggcaccgatatgctgtgtgatacctccagcttctccagtagcaacacgagaattacgtagggtgtccaacaaggttgttttaccatggtcaacgtgtcccatgatagtcacaacaggtgggcgttctgtcatctcttcttcattgaggtagccctcttctacgaagaaacgctcaatatctgcgttatcgacctctaccttttctttcgcttcaataccataatcaaccatgaggagttcgatagtatctccatccaaagattggttttgagtcgccataactcccataaggaagagttttttcacaatttcagcaggttcacgtttgattcgttttgcaatttctgcgacggtcatgccagcagtatattcaaattcagttggcaattcgtggaacttgcgttctgtgacaggtttggcaggttggttagccttgccttttttatttttcttgttgttattccagttacttgttctttgatttctcacttgattttgactatttcgatttctttgttgtttccgtggaccatcttcttcgtcactattaaagtcacgttttttatctggtcgagcttgtttcttacgacgggtatctacagtagtttctgcaacttgctctggtaccgatgcaacaagtgcaggtttcacaaatggtttgctttccacaaccggttcttcaaacttaatttcttttggcttcttaggttgctttttagcttcctgagcctgacgaaaacgttcttcactggtacgagcatactccgcattttgttctgctttcaaagcagcagcacgcgctttgaagtcaattttaggtcctgctggttttgcagcctctctttgttcaaagcgagctaaccgacctgaacgattgtcctgacgacggttgtctcgattatcgcgacggtctccaaatcggttgtctttccgctcttctggacgctggtcacgacgattgtcgcggcgatcatttcgctcattgtttgaacgtccctgacctagttgacggttgtcacgacggtcctgatcagatttagcttgaccaccttttccttgattctgagctcgcttagcagcctgctctttggcccgtgcttcacgctctgccttaaagtttcgactctgtggacgatgtgaagctgattgtactgcacttgccgcaacttcttcttttactactggctgtgtttccttagctttttctaccttagctgtttccacttttggagtttcatcaaccttctcaggcttgctaacttttgccgcaactttagttgcctctgatttttgtcccccaaagctttctgcaaggcgtttagcacttgcttcatctacgcttgaagcatgacttttgacttcaaaacccaattcttgagccttagcaacaacttccttactgcttacgcctaattcacgggctatttcattcaatctcttcttagacaatgccttgtcctcctgttctattccataatagacctcatcttctttgtaaatccagcgtctgtcactgcaagaacttttctagccttgccgacagctgcactcaattccagtgttgaaaacactgttacaacttctacttgataggtatgacttttatctgttacttttttacttaaatttccagcagcatcttcggctaaaaacaccaactttgcctgccctttttgaatagcttcaacaaccaggtcctcacccgaaaccaggcgaccagctcgctgggccaaacctaataaatttaagatttgctgtctcttattcgagtccaagttctctcctcttgatcttatgatcaacataggcaattaattcatcgtaaaattcttcggccacttccatactaaaggaacgatcgaagacacgacgtttcttagcttggcttgcctcatcattgtcaagcttgatgtaagctccacgaccatttgccttgcctgttggatcgataaatacttgaccttctttattttttacaatacggagcaaatcccgtttgtcgatgatttcaccggacaccacagacttgcgcaagggtatttttctagcttttgccatggttgctccttttgccttattcttgttcttctgcgacttcttctacaacttcgtctgttgcatattgagttgcttcaaaagcttcatactccgatgctgacttgatgtcgatacggaatcctgtcaaatgcgctgccaaacgaacgttttgaccacgacgaccaattgccaatgacaacttatcatctggtacaacgactgtagcatgtttcccatcttccgtgtcaaacaatacttggtcaacttcagcaggtgcaagggcattgtagataaattccgcttcatctgctacccactcgataacgtcaatattttcctcagtaggaatcatacggtcattcttagcatcataacgagctgggtggaatttgctagtgattttcttaatatttgaaccaccacgaccaacgatagtaccaatagcatctacgtttggattatggctacgaacagccactttcgtacggtctccagcttcacgggcaacactcatgatttcaactgttccatcgtatacttctggaatttcctgttccatgagacgtttgatcatttctggatggctacggctgacaaatacgttaacaccacgaccattgtcttctaccttgtagacatagacttcgatgcgatcatgagattggaaaacctcaccaggaatttggtcttgttttgacaattgtgcttcaatcgtaccaaggttgacatagataaagcgattatcaaaacgctctaccgtacctgacataatctcattttcatgttgcttgtaggtattgaaggtaatggcacgcttttgtttgcgcatcttttccatgatggtctgtttagctgattgagcagctacacgtccaaattccgctgggtcttcttggaatttaattttgtcacccatttcataagctgatgaaatagccaaggcatcttttagactaatttctagtcggctatcaaatacttcatctactacttcacgaacagtaaatacatggaaatcgccttttttctcgtcaaattcaatcactgctgattctgattgaccataacggcgtttataagctgaacgaagcgactctgtaactgcatcaatgatatccgctttgttaatacccatgtcttcctctaaaatacggaaggcttctagcatttctttactcatgttgttttccttttgcgctcaaaaggtcctttcttaaagtctaatatctttataaaatactcatgaaagagcattataacttaacagccaaacgggccttagccaccgtctggtaaggaatagttacttccttcttacgagttttatccatatactccataatcaggtctgttccatcaaaggagagcaacgttccttcaaaaaccttgattttatcaattgcctgatagagtttgacatggatgtactttccaaccgccttctcaacagcatctgccgtttttaaaggacgttccaaacctggacttgttacctccagcatgtattggtctggaaatgggtctggtttgatagtgtccaaaatcggactgatcttttcggataaatctgccgtatcttgaagggaaattccaccctccttatcgacaaaaatcgataggacatagtcaccgcccattttaccatattccacatctaccaactcgtaaggagtttgaatagcgggggtaattgctgctgtgaccaattcaataattgatgacataaacacctcctatttttacagtcgctagaaatacattactcaaatagttcgcactatccaggactctctatttcctttgacagtaaactcccttgtactatcattcattctatatacagaaatccgtgtacagggaaagggttgactgacgccaaccccttttctcattattcacttccattattctatcatatctatccctatttgtaaaggaaaacgatggattatagacatttataatcttttagtttacttttagtactctctccaaaggtttggggaacctttggaggttggagatagggcgaagcaagttcacttcaatagctgcagacagcttgtacagtcgagtgactgtgcaaggttggagatagcccttgcggagcaagtcacccctgaagagtacggcaaagcgaattcaaacaatccagtggagtgtttgaacttagaaataaggaaacggaatttcctcttacgtcgaagtaataaaagaaaaactgaatgactatagtttattcgacaaaggaaaaaggtctctgttagacctctcctcattttccactaagggaattattgaaactgtgcttccacacgatagatgacttgacccttgtttgagaatttctcctcatactctgtcataacgttaccttccaaaccatccgcatgcaaatctagccaaacctgcttcaagaccatgccatattgagaaaaactagccaggctatactcaaacagaccacgattatctgttttgaagtggatttctcccttctcaggtaggatttccttgtaggtatccaagaatgacttgtaggtcaaacggcgtttctcatgacgtttcttaggccatggatctgaaaaattcagataaagctgatctatttctgccggtgcaaaatagttggtcaaactcgaaccatccacctgcaataattttatatttggtaaaccagcttcaagcacacggtccaaggcatagcttaacacggtcatctgaatatcaataccaatatagttaatatctggattttgcgcagccataccagtgacaaagcgacctttaccagaaccaacttctatgtggataggattattgtttccaaaaatctctgcccatttccccttacactcctctggattggagataacatactggggattgtttgctagaagctcactcgctcccttacgatttctaactctcatacttccttatagaaactctgacggaattgccgtagagcataaatttctttatttgcagccaaaacattgtagctttctacatgcttagctatttggtttagatagccaagctggccataccaataaaccttatttaatactgtgctgttatatttgtagccataagcccgaagccactcttcccaggactgacgaggaatataatgcgtcaaaatataggcaacatccaacatccgatccgttacacaagcggtctcccaatctgtcaaatacaccaaaccagacgtcgtttctacccagttactatgatgcaaatctccatgaacaaatgttgccacctcttgacggaatcttggtagattattcaataaatcttgacagatagattgcagataagaattctgtcccaatctagttggtgcctctttttgccaacgataaaccaaatcctgaggttccatataggtataattcatctgcaaagcctgattgagcaaaatgcgagaatagtgcattctcaccagtatttgacgaatctgtttactagtcatatcttgacgctccaaggtacgaccattcaaccactcctgctctacacgatgccccattcctacttcacgatttgctgacaaaacgggtggtgtaatttgctcacgcgcaagagcagacactatcggaggcatctcatacttcacaaagactggcgttccgtctgaccgtaggcctttaaacgctttgccactatttcctgcaatagactgtaattgtagcccactggtatcaaactgcatgcctttcctcctttaaaaattccttactattttactaattttcgtctatttagtcaatcaatttttttaattttagaggcaaatatatttcatgcaagaaaatccccacgagaagtaagacgactaccatcgcattctctttagaaaatagcagagcaaagcccaattccactactaatagactatataaaatcactctaagcaaattctgaagaccaattttcttggaatctttctccagaggatacagttgtgttatatattgataatcataatgcttgtaaagccccaacaactggaagacaagcaaataatgaaagactaaaactaggccgatggataaccacgattcttcaatggcaaatagggacaaaatcgccaacaacagtagacgtatcgtcaagcccaagtagtctcctgaacgcaagaaagcccgtaagtagagataaaaccaagtctgtctcgacttgacgagacgcaagattccattgagatagcttctcggtttaacagtcgtaccgattcctttaaccgttgtaaataaggcaaagaaacgtaaaatagactgtttccttttttgttcatcttgaatagccttagaccagtccaatactccctgtgactgataagccactaattggcgcttgacaaaaagacattttaaaaccaacaaagtaagaagaccagatacaatcatccacaccggtaaacccagtttcaaatagattggtaacaaaacaagctgaaccaccacctgtatagaggaccaaaacaagaccgtgcgtctggctgcaacctcgagtccttgcagaatgtctttttccttggtcaataggaagatttgatcagcttcttctaaataagtcgcaattcttccggacaatagcaccagtagactgattgcaataaccaccaaaacaatcggcaacggattctcagggaatgacaacaataattgacgatattgcaaactcaaaaagcctaataaaaccatgagaaccaaaacaaaatggtcattcagaacatagcgcagatacttggaacaacgatttaaaaaatctagtcggcgttgttgaaacaattctttcatccagccactccttcttgcgtcaaggccagataaatttcattcagacttgcaccatccataccaaatgcgctttgtagctcctccaaatttccagttgcacggacctgtccctgatgtaaaatcacaaaagagtcgcacattttctcagctgagtcaagaacgtgagtggacatgaggattgaagtgcccttagatttttcttcccccaaaagagcgattaaatcagagatagccacagggtctaatcccagaaaaggctcatcaacaatcaacagactcggctccaccataaaagcacaaataatcatgaccttctgcttcattccctttgaaaaattgacaggaaaccagtccaatttctcatccaagcgaaacagttttaacaagtgctcaacacgtccccaagcttgctcccaggataaatcataggccattgctaccacttccaagtgctctttgagggttagttcttcatacaaacttggtgtttcagggataaacccaattttcttccgataattttcagccccttgtagcaaagttaggccgtcaattacaatctgtccttgatagggtgtcaaaagaccgataatttccttaatagtcgttgatttccctgcaccatttaaaccaattagaccaactaattgaccatcctcaacggtaaaagatacatctttcaaaactgggatattgacatatcctccagttacattttttacttctaacatacatttcttcctataatttgatataattattataacaaaaatcctagaaagaggttgccattatgtcggattgtattttttgcaaaattatttctggagaaataccagcttcaaaagtctacgaagatgaccaagtattagcctttttagacatcactcaggtcacaaaaggacacacattggttgtccctaaaaaacactaccgaaacgtgcttgacatggatgaagaagctgcagccacactcttttctgttgtgccaaccatcgctcgtcagttaaaagaaaaacttagagctagcggtctaaacatcgttaataataacgaggaggccgctgggcaaaccgtctttcatacacacatccatctcttaccacgctttaacaatcaagatggattgagcattcaatttaaagccaacgcccctgacttcccagccctggctcaactggcacaagagctctatctaggagaataatatgaaacttcgtaatatcattttagccgtaagcgccgctaccgccagcttccttgcagtcacgcatcgggataaaattaccaaagaaataaaggaaaccaaacaacttctatcagatattcaactgagcaaggacaatattcaggaacaacttgccattatccaaagttttcaagagcccttgcaggaaatggcttctgacttacaatataagactcgagtctatcagcaaagtattgcaggaaacttggaagaaatccaacagattctcaaaaaataccagaatgagaataacactccctaacatctggaatttccaaatatataaaaatagaggttgaaaacaacctctatttttataggcttttagtactcgctcgtcaaagtaataaaagaaaaactaatgactacattattgtgccccgttttcatcaccgagtactggctctgttgaaaaatcggttacctgctcttctgttgtcacagtcgtagtagccgatggactccctatttctggatccaagctttctgcccatggacttgcttctaacagcaagagatttgtatatgcatcataaacgtttattggacttggcaatcccatctgtccttcgtagaccttcacgtttgtgactaagtcggtcttttcttctaagccgatagattttttcagaacattttgcatttccaatagatgtgtactggttggtaattgataatagattgcatcaaccatttgatccacaccgcgcaactgataggaattcaacttggagacagagtccttgtaccccaagagatttggaattgttacaggactaatctcaatgttggttcgcatattattagaaatggcagtcagaatcttcttatactgggtaaaaccgtctaactgaaggagtttttttataatagccgttataacttcacgttgacgtctctgacgaccaatatccccctcaggatcatcatagcgcatccgagcataaaccagcgcctgatccccatttaccaactgtttccccggctggacaatagaggtgtaggcaggctcatgttccgaaatggatatagggaagccaagagtattgtttacctcaatacctccaaccgcatcaacaagctcaaccagaccatccatatttatttcgatataacggtcaatgttaatatccatcatcttttcgatcgtggcaatggccattggtgcctgtccgtagctataagaatgatttagtttttcaaccgttcctgaagactccccattcgcttctgcaatctcaaccataatatcacgagtcaagctcatcatattggtttccttagtcttgggattaacagttaccaaaatcatcgaatcactacggccaccctcccaatctcccccgcgggtcgcttggtccatatccacccccatcagtaggatagttaggggctctgtcgcatcaatcggagttattttttcttctccatctagctgcttaaatgttttcgaaatagcatccgtagaaaaatttaacaagctggctccatatattaagccggcacctactgttaaaccaataatagccaaagacattaagaatattttttttccaattgtcatacttcaccaattaacttgcccatataataaagatcaagccattctccttcatctgttctagccccacctatctgggttccttcaatgttgaatcctagtttttggtataaatgtactgccgcctgattgcgaacctgaaccgttaattccaaacgcttcaatacatccatttcctctgcccaatgcaatacttcctccagtaaaatcgtccctataccgtgaccccagtaggctttttttactgcaataaaaatatttccgatatggctaatgcgaaactgcttagaggacttaacagaaattgcgccgacgacttccgaaccaaccttagccaacaggcacaattcacgaggattttcgatccctgcgtcgaagatggtctctatttcatcaacactaaatcgaaaaccagtctcatccatgactagataatccgtttctctagcaacttgattcataaaatcaataaaagctgctgcatcagctggttcagcttcactaaaatacacttctttttcagacattttggaactccttcgctaaatcgctactttgagctccatgagattcgactgtcaatcgtcgaccatctccctctttctctatacgaatgagcaaatagtcatcaaatagactgacatccagtaattctccccactcgataaccgttagacctcctccatagagaaaatcatccaaatcaatcgagtcagggtcatctccaattcgataaacatctaagtgatagagcggcatggccccctcatactctcgaacaatcgtataagtaggactcttaatcatctgttcaatttttaaccccttggccaaacccttggtcagagttgttttcccagcacccaaatcccctgataatactagaacttgatttggcttacaggcctttccaattctctcaccaatggcaatcaattcattttcattctgactatacatgtctttaattataccatagccccagtagtttgtcataggtctactggaaattgtagacaagtcgacagaaaaaatcgcaagccagagcctgcgattttgtttattctacgctgaaaagatatggatagactggttgatttccttgatggatttcgacctcaacatcttcaaattgttcttctagctgttcagcaagagtttgagccaattcttcattaccatcttcaccgatgtagatagtcacgatttcgctgtcttcatccaacattttatcaaaggtagccacaagtgtctccatcatatctggattagaaaccacaatcttgccatcaaccataccaaggttgtcattctcatggatttcaagaccgtcaatggttgtatcgcggaccgcagttgtcacgctaccacttttcacctctgcgagagatgccgtcatcgcttcaaagttgctttccaaatcacgacttggatcaaaagcaagcaagctagtaaaaccttgtggtagggtcttagtttccacaaccttaaccgcaacttctgcaacctcagcagccgtctgagcagccatcaagatatttttgttgtttggcaacaagatgacattgcgggcattgaccaattcaatagcattgacaaaatcttctgttgatgggttcatggtctgaccacctgaaatcacatagtcaacgccttgtgatttgaagatttctgtcaaaccttccccagcagctaccgcaataatagcatactctttttgttcagccggtttttggaaactttctactttctcaacctgagcttcatgttgctcacgcatattgtccacttttaccttgaccaagctaccatattgaagacccgcttgcatgaccaaacctggatcttctgtatggacatggactttaacgatttcatcatcgttgaccacaaggagggaatccccaaggtcgttaaggtagttacggaattcttcataatcaaagtccttgacataagtaggcccctggcgaagagctaccatgatttctgtacagtaaccaaaggtaatatcttcagtcgctacatgacctgcaactgacttgtggtgctcagcattgatcatttcagacataacagcaggtgtcgcctcaaaatcttccgaagcaatatactcacccgtcaaagctgacaagaagccttcataaatgtaaacaagaccttgtccacctgaatcgacaacaccaacttccttcaagactggaagcatctctggcgttttcttaagagcacgattagcaccgtcaagagtggcacgcatgacctcaaccgcatcatcagtctcttctgcctttttcaaagcggcagtggctgccccacgcgaaacagtaagaattgttccttcaactggcttcataacggctttataagccacttctacaccatgttgaaaggcttgcgccaaatccttaccgtccaattcaaccttgcctttaacagattgaccaaaaccgcggaacaattgcgacgtaataacacctgagtttccacgagctcccatcaacaagcccttagaaagaatttgcgcaacttctccaacagtagaagcagacttatctgctacttctttagcaccattggtaatagtcatccccatgttggtaccagtatccccatccggaactgggaaaacattgagtgagttcacatattcggcttgtttattcagacgagttgatgctgcctgcaccatttcttgaaataaactagttgtaattttagacacaattattctcctacgactttgatattttggataaagacattgacggcatctacagagatacctagttgattttccaagttgaacttaacgcgttcttggatgttgcgagatacttcactgatttttacaccgtagctcatcacagtataaacatcgactgcaatgcgaccatcttccaaggtcttaatcacaacacctttagaataattttcttttctcaaaagtgcttgaaaattatccttgatcgcagacttactagccatcccaacaacaccgaaaatctcagtcgtagcaccgccaacaactgtggcaatcacgtcatcagtcaattcgatttggccgtctttagtattgattttaacagtcataattcgttacctcaaatagttttatcactccattttaccacattttctgctttctgtaaaaaacaagcttgttacatcggattttacaaaaacatactaagattagtagtgaggaaatctccgacgggagaaagtactcactactttttctttatgataaagtagaggtgtcttgttaagtcgagaactcttttgacgctagacgtcgcaacaaaaactggcaagacacctgttttagaaagaatgttatcaaagtatgtgggacgccagacgtcgagtattgaaaatgacatcactaaaacaaggaatcattcaagacaaagaggtaatatcatgcgagtagtttttgggattgatgtgagtaaggcaagttcagaagtggccattctagtcaacggcgagaaggtacataactacaccatgtccaatgatgccattggcttttctcggctacttggcgatttgaaaaccgtccacaagccagaaatcatctttgaagcaacaggcgtctattctcgtcgtcttcaagcttttctggatgaacatggctacgcttatacacgactcaatcccttagaagccaagaagcaactggatagcttgcgtgtgcggaaaacaaatcaaattgacgctgaaaaactggctcaatctcaatttgtgctgaatcgtaaacccacttatgtccaagaagaagtctaccaaaacttgcgggatctcagccgtttctatcagaatctgaccgaggatattgttcgagctaaaaaccgcctgcacaaggtcttacaggtcactttccctgaattggaaaatatcttgtcaacaccatctggcgaacaatactggaacttagttatagcttttccttgcaaggacttcgtgcttgagttaagcaatgatgaactctcaaagagcatccgtctgtccacttcaaaacggatttctgataagcgtgtggcttacttagcagaaaagcttatagcactagctaatcaatcttattgtgccgtcaagaaaacctctccaatactggaagaggtccgttactatgcaaagactttatgaacagagacaagctgtcttagacgaaatggtggaactagctcagccattacctgaatatgacattctgctctctattcctggaatagctgagactactgcaacaagtattattggtgaactgggagatattcgccgttttcagtcagccaaccaaatcaatgcctttatcggtattgacctgagacactatgaatctggtaacttcctcgctaaggaacacattaccaagcgtggcaatccctacgctagaaagattctgttcaaatgcattcacaatatcgcttcagccagtcataccaatccttgccatatcgcagacttttatgagaaacgaaaaagacaatcgcaaacgacttcaacgaagtcgcacacgattgcctccatacatcgtctcattcggacaatgtattacctcattatgcataacaaactttacgattacgcttcaactcaaaatcggtaaaactgtttatgccatatcattgtaacaccttatcaaaaaatttcaacataaggtgttggttttgtatgcactttttacactaaaatttagtccaaaataaaacaatttccttattttgactattgaactcaaaatatttttcgtcaaataccttgatggacttgacaaatagtagaaaaaagagttcccaaaggaacccttttcacaattaacctaaacgctgcttagcatctgctgcacgttggaaagcttgtccgacatagttgatacagagcatcatcacaaggatgaagatggctgctggcaaccaaatccatgtcttgttttccaaaatatctgcattgcgagcattggcaatcaaggtacccaaacttggtactgtcgatggcagaccgaaaccaagataagtcaacgaagtctcgataccgatatttcccgcaaagttcaaggtcaagttaacgataatcaatgaacttaagtttggtaaaatttcacggaacataatcataaagtcgcttgttcccaatgtttttgatgcatttacatagtccaaacttgcctctgacaaagtccttgtacggaatagacgagccttggccgtccaataaaaggcactcatgatgagaatgaaatgatagattgtatagttcttgataactgtcacgaaaacaataatcaacattgtcaccggcaaaatcatgatgaaatcgacaatacgcatcaagaatccatctaaacgaccgccataataaccagaaatcagaccgacagaaatcccgacaatacttgtaataatcgtaatggtaaaaccgataatgattgagttacgagcgccgataatcagctgaccaaagatatctttaccaccttcatctgtccccaagatatagccgtcaacacctggttccaagtaacgtcccaaaaggttgactttcataacttgttcttgattcaacagaagtgcaccgataaagactgctaagagaaccgtcactaagataattaatgaggtcaatgcaagtcgatctttcataaactcccgcgcgatgacacggaagccacctggaggagttgaagcagattgtacttgttttttattttctttactcaccttactcctccttctatttcacacggatacgtggatccacgatactcatgataatatctgaaatcaatgtccccaacaaagtacccataccaaataccaacaataaagctaagataacactatagtcacgactagaaatagagttaaagaataactgaccgatacctgggtaagtgaaaatattttcaataaagatagaaccaccaattaatcctgtcaattcatagcccaagaaagatgcgattggtaaaatcgaattacggaaaatatgacggttataaacaactctctcaggaacacctttggcacgagctgtacgaacatagtcctgactcttagcatcaataatccccgtacggagatattgaatagtaactgttgttgacaaaatagccattgtaatcgctggcagaatcatatggtgtaaacgactgagagtcgctgcaaatccttccacacctccactaatcgaaccacgcgtcgggaaccagcccaaactaaagccaaacatccagagcatgagaatggcaaaaacgaaagttggagttgaaaatgtcaagaagttatacacgccaatgattttatctgcaagtgagttttgataacgacctgcaatcatacccaatggaagtgcaatcaaataagtcaataccatcgtcaagagggataatccaattgtattattcaagcgctgcatgatgacatcaacaactggttgtttaaaaataacactctgaccaaaatctccttgcaaaagattgcctacccagcggaaatactgaacagggattgggtcatagtaacctgccgcaatccgtttttgttcaatgattgctggatcaatattggggtcaatcaatcctgtaaagggatcccccggcatcatcttcgcaacaaagaacgcaatgacactcaaaataataatctgcggaatcatcatgagtaaacgacgtaatactgttttccacatcttagttctgacctccttctggaagggctacttgatgagtttctgagaaggatctcaaatcgtacacacgaccgttttcatcatagtattgaccttgcatttcttgatattctttttcagcagccaaacgcttttctttattcttcaatcgattgagtgggtcaatcgttggaatagctgacaacaaacgtttagtataaatgtgttgtggattattataaatatcgttcttatttcctgtttctacgaaacgtccgcgatacatgatgaacaattcatcacacatgtgttgcacaacaccgaggtcatgggaaataaagagatagctgagcttaaactcatcttggatacgtttcatataattcaagacctgtgcctgcacagacaaatccaaggcagaaaccggctcatctgcaataatcaaacgaggattactagccaaagcacgagcaacaccgatacgttggcgttgaccacctgagaattcgtgaggatacttaatcagagcttcttcatttagaccgattgtatccaagagttgaagaacttttttcttttcttcatctggagataaacggtcaaagttacgaattggttctgcaatgatgtccaagatacgttttttcgggttgaaacttgaaagagaatcttggaaaatcatttgaacatcacgattaaagtttccttttttaccacgtgatttgttggttacatcttgtccttcatagataatctgaccagaagtggcacgctctaaaccgataattgccttaccaatggttgatttcccagaacctgactcacctaccaaaccataggtttttccttcttcaaactcaatattaacaccatccacagcatagacatggtccgtcacacggttaaagaagccactacgaattggataatggacttttaaatcttttacttcaataaatcccactattaggcctccccttcaaaatagaatgtctcatggcaggtacaacgaacaaagtgatttggacctacctcgtgcatgctcggattctcttcatgagcctctgctccaatccacggaatacgcggagcaaaacggcaacctttacgaaccatttttgtaatcggcggcacaataccttcaataacatgaagatcgcctccttcgctacctgattgaggatttgacttcaagagcgaacgtgtatatggatgtttaggattggtaaacaattcttctactggcgctacttcgacaaactgaccaccgtacatgaccgccacacgatcagcagtttctgcaactactcccaagtcatgggtaatcaaaataataccagaacctgtctccgcttgaatatcatttaagagatccaagatttgtgcttgaattgtaacatccaaggctgttgtaggttcgtccgcaataataattggcggtttacaagacaaggccatcgcaataatgatacgctgacgcataccacctgaaagctcatgtggatactgtttaaatgtccgcttaggatttggaatacctacctgagccaagagttccaaaactcgctctgtacgagcattggcatccaaatcagtatgatagaacagtgcctcatcaatctgtgcaccaatcgtcatcaatggatttagagaagctaagggatcttggaaaatcataccaatatcattaccacgtactgtattgtacttagcttcatccatgccaatcaattccatatcattgtactggatgcttcctgtgattttggtattcaaagggttatgcaagcccatgatggtcgttgccaaagttgattttccacagccagattcccctacaattgccaaaatttcatttttttgcaatgagatgtcaacaccgtcaacagcgtcaaaataatcatctccaatacggaaaccgacgtgtaaatctttaatgtctaaaagcggtttttcggtagccacgctttttcctcctttatgtgccagctaatcaagctcaatcaattcaatagccttacgattatcaagttcatataacgtttgattaactgactttatataactactctagaataacatatttctaccaaattatcgtttgatagcgattacccagaagtaaaaaatgtacctatatccaatcataaatcaagaccatccctatcactgtctcaattaggaattgagtaggttaatgttcttcatcttgagtttttgttagtagggactcatttttgtgtactgagtctactataccacaattatctgaaaattccaatagcaatctgaaaaaagccaatcaaattggctttttcagattctattgtcttctaacaaattattctgccactacacccttatcagctgtcaattcgataccctcataagcaagacctgtacccgaagctgagccgtattttgtatcatagcttttcacacgtttattaacagcagtaattttttctgactcaaacgttggaatagcaaatgcttgctcgtgagcatatttttgccaagccttatagttctcaacgtttttcttatcatcaaacgactctgctgagctgatagcttccaataacttggtgttttcatcggacacgaaacgtgacatattgaaggctgcgataggcccccatagaccacttgggtttggatcgtaacctgttgaccatccaccagcatacatatcaatagcagcatcattagcctgaactgagttatagaacgacttaccttcaactgtacgtcctgtgtaaagttcgacattcaagccaacttctttccaccaagcaatgtattgttgtacaagcgcttcgttagcttcagtacgtttacgagccgcaaaggtaatcttgaatgccttaccatctttgccttcacggataccatcaccatctacatctttgtagccagcttcatccaaaagctttttcgctttttcaggattgtatgaatagccttccaactctgaatcatgaatatcgccgaagaatgagataatcaatgattttgcagggtggtaaagaccgttgtataatgacttaccagctgtcttggtatcaatcgcataggcaatcgcttgacgaagtttcacatcattcatcttggcattttcatccataacgttcttaccagctgcttcgtcatatttaccaaaattaaacgagatatactcataagacgactctaactgaccaacgatattcaagttagaagcatccttatatgaatctaactgatcaaccggcatttctgcgatatcataattccccgctttcatttcagaaacaatagtatcaggagatacgatgtcaatcttcaatgagcttgtttttggtttcgtacccttgaagaagtattcgtttggtacgtaagtgatagactcaccattgacgatttccttaatcttccacggccccataccaacaagcttcgcagtacgtgagtattcgctcttttcccagtctgcaacagggatgtctttatagatgtgttctggttggatataggctgggacatcaccacctgcatacatcattgaaggtgacatttcttttacagttaattctactgtatagtcatcaactttcttaataccagagatgtctgatgcttttccatcaacaaattcttgcataccttcaatattcaagaatttatcatcaaaacgaatacctgtatagtctttgcttgccatcgacttaattgtaaagatgtagtcgttgattgtgaatgactcaccatctgaccacttgtaatccttaccagtcaagctgactgtgattttcttgccttttacatcaaattcagccttggcaagacctgagtcgtccaacttacgttctccgtcgtaaccgaacattgaaatatcaaccataccaccaaatgttgaatcagtagtattctcagtcaactcatcaattaaaagacctgatgaagttgtaggagatacccaagcatatttcaattgagcatctgcgactgctgttccatcttgttttacttcagccgggaatgacaattcctgttttgctgcacctgattgttttgaaccacatgctgcaagaacagatgctgaaaggagagtcacacctgcaagtgcaaaaagtttcgttgtctttttcataaaacacctctgttttctttttgtttgacacttattactatgtcttataaaaatcattatatcataaatttttcttaaataaagtctttttgtcagaaaattttgtaaaaacatattttttcatcattttctcattttttacatgttttttccaaatttttctcacatttcttgtgatataatagaataaaataccccaaaaaggaatgattatgcgtaaacttttactaacactcactacaatccttgctgtttttttaacttccacacctattttggcagaagatttttctgttgcagccaagcatgctatcgcggttgaagtaagtagcggcaaaatcttgtatgagcaagatgccgaaaccaaagcaagcattgcttctatcagtaagacattgagcatttacctggtctacgaagcactggcaaagggggaaatcactttagatactatggtagatatttctgattatccctatagcctcacttctaatactgaattaagcaatgtcaatctagatgaacgctcctattctgtaagagacctattaaacgcttctttaataacatcatccaacagtgctattattgctctggcagaaaaaatagccggtagcgaagctgcattcgtggatcgaatgaaggcaaaagtccaagaatggggaattaccgatacaaaaattgtcaatgtatccgggctagataataccgacttgggtgaaaatatttatccaggttccagtcctgaagatgtaaatatgttttcagccctagatgttgctatcatcgcaagacgattaatactcgactatcctcaggtactcgacattacctcgctaaacgcctacgattttggcggctacacttactatagtaccaaccaaatgctgagcgacggcactcacgctcgtggaggggtggacggcttaaaaacagggacctcaaactcggctggttcaagttttcttgcaacaactcaacaagctggtatgcgcattatcacagtagtattgaatgccaatgatgggctgacctctccagaaaatcgctttgtcgcgacaaatgatttgatgaactatgtttattctaacttttcgcttgttacactagtaaaaaaaagtgaagcctttggagatagtaagataaaggttttcaacggtgaaaaagaaacaagtcctgttgttgcagcagcagatttaactgttgttcaacgaaatcaaactgataatgtccccaccgcaactttcacaacggatatcaaagaaattgatgctcccctcaaagcagggaccttggtcagcaaactacaactgaaagatcaagatctcattggaaaaggttatatttccgagcaaactggtgtcgatatgattatccctagcgatatgaaagaagcatcctggccattctcttggtggaatcaatttgtccgctatgtcaatgaaaaattataaaaaaatagtatgtcgaacgattttcgacatactatttttttattgtagagtgacaaccgctactccttatctccagcctcggttggagagtgagttggtgagagttcctgacagaaaatgacgagcgtggaaggtaacaattccattcgtcaatttataaagaagagctactgccgtcgctcctcatctcctacttcagtggggagtttgacgggcttgaacagctttaaagctgttcaagttcgcggcaaactatcccactgaaccctccatctcataggcaatcagtctgttgagttcgactgcgtattccattgggagttcttttgtgaatggttcaacaaagcccatgacaatcatctctgtagcttcggactcggacaagccacggctcatgaggtagtagagctgttcttctgagatttttgatactttggcttcgtgttcgagggccacttgtgagttgtggatttcattaaatggaatggtatctgatttggaaatatcatccataataatggtgtcacactcaatgtggctgatagacttggctgagtttttcgcaaaagtgacttgaccacggtagttgacttctccaccaccacgggcaatggatttggacacgatagaagatgaggtgcgtggggcgttgtgaatcatcttagcaccggtatcctgtacctgacccttgttggcaaaggcaatggacaacatggttccacgtgccccttcaccttctaggtaaaccgctgggtatttcatggtcgtcttggcaccgaggttgccgtcaatccactcaactgtggcatttttctcggcacgggcacgcttggttaccaagttatagacattgtctgaccagttctgaatggtggtataacgcatataggcaccttcgtgggcgatgatttccacaatcgctgcatgaagacttgccgttgagtaggtcggtgccgtacagccttctacgtagtgaacacttgccccttcatctacgatgatgagggtgcgttcaaactgacctgttccttcattgttgatacggaagtaggtttggagtggaatatccagcttgacaccttttggtacatagatgaaggttccacctgaccaaaccgctgagttgagggcagctagtttattatctgacggcggaacaagttttccaaagtattttttgaagagttctggatgttccttgagagccgtgtcggtatccgtaaagataatgccatgcttgtcgtactcttccttcatgttgtggtagaccacttctgattcatactgggcagaagcacctgctaggtaggcacgctcggcctctggaataccgatgcgttcaaaggtttccttgattttgtctggtacatcatcccagctgcgtgctggcttatctgacggtttttggtaatagacaatgtcatcaaaatccagctcagacaagtcggctccccaagtctgcatcggcattttcttgaaggtttcgtaggatttcaaacggaattccaacatccattcaggctcgcctttgatacgggacatttcacgaatgacttcttcgttcaaacccttacctgtcgaagccaccagttccacgttctcgtcatggaaaccgaatttgtattctccaagatcaatcggggttggttcaattctttcttctgacataatataagatactaagccccttaagaaagcaaatgaaaaacaggaaatcgacttcgtgtgcaaacacacgcggagatttatcttttttcaaaagcttttagggcgagttcaatttcatttccaatcagaaactgaacaatcctttctgtatgattttcatttttgtttattcgatgatgctcagtaagcatcttcacttcgttcgattgctttcttcaagacactaaacttggttggaactaaagttcctaaccaagtaacgcaaggttctaatcaaccttgctaagtggcttactaattggctgattttggtaatatcgaccaaaatcgctcatgtcgcagttacccttcattcagcactggaacgaagtgacagtgctttcttcagggcattccacggtaatgtggcacatttgatgcgttgggggaatttggcaacacctgcgaggagggaggcgtctcccagttccttctggcgtgggtcttcttgacctcggaccatttgtgagaagatttctgctagttcttgaatctgactgatttctttgccaagcactgcttcagtcatcatagaagctgatgcggttgaaatggtgcagccaacgccgtcaaaagcaatatcggtaatcacatctttttcaatcttgacggacaattcaatcacatcgccacaggttgggttgtggagttctaacttttccactccgtccaagcttccgcgatgacgaggcgacttggagtgttcagacacaactgccatataaagagagtctaatctagatagggccattgaaaaactcctttgtcttgatgattgcctcgaccaacttatcacagtcagccttggtattgtaaatgtaaaaacttgctcgtacagtagcaggcacctgcaaatatctgagaagcggttgggcacaatggtggcctgcccgcacagcaacaccttcatagtccagagcagttgccacatcgtgtggatgcaagtcgtccaagttaaaggcaataactcccgtccgcttggacaggtcctgactgccataaatggtcaagcctggaatagcctgcaattttggaaagacatagtcaaccagttctgcctcgtgggcctggatagcgtccataccaatttcggtcaggtaatcaatggccgctcccagaccaatcgcacctgcaatattgggcgttcctgcctcaaacttccaaggcaattccttccaagtagctgactgctcatagacaaagtcaatcatttcaccgccgaattcaactggcgacatgagattgagcaattcttccttgccgtagagaatgccaattcctgtcggtcccaacattttatgacctgaaaaggcatagaaatccacgtctaattcttgcacgttgacgcccatgtggggaactgactgggctccgtccaccaccaagtaggcaccgacttgatgcaccagctctgctatttccccaataggaaccacgccacctaggacattggatacgtgggccagggagacgaacttggtcttagaagatagtagcgaccgcagatggtccatgtctagctcgccgtcttttagggtcacatagcggagcttagcacccgtttgctgacaggcttgctgccaagggatgatattggagtggtgctcttggaccgagatgatcacttcctggtctggctggagaatttcctttgcaaactgagccacccagttaagactagtggtcgttcctctggtaaagagaatttccttgctagacttggcctgaataaaatctgccaccttctgcctagccgcctcgtagcgagtagttgcccgttccgaaagggtgtgaacgccacggtggacattggcattgtccttctggtaataatccgccagcacatctagtacctgctgcggtttttgagtggtcgccgcattgtccaaatagaccagcggctcatcgttaacaacttggtctaggattgaaaattccttgcgaatgcgttccaaatccatatcttatctctttgttagtttttcttcaatcacggcaatcagttggtcacgaacttccttaacaggaatttctgtgataacagagcctaggaaaccacgaacaaccaagcgttcagctgttgctcggtccagaccacgactcatgaggtagtacatgtcttctggatccacctgaccgattgaggctgcgtgtccagctgtgacctcattctcatcgataaggagaattgggttagcatctgagcgagccttatcagacaacatgaggacacggctttcctgctgggcatccgctcctttagcaccgcggacaatgtgtccgatgccattgaaggtcaaggttccactttctaagataaccccatgttgcaggatgtgaccgaccgaattatgaccgtagttggtcacgcgcgtatccacaccttggacctgacgacctgatgacagtccgacaactttgaggttggcatggctaccgtttccttttaattcgctgtccaaatcggcaaccacatttccttcgttgagcagaccaatcgcccagtcaatcgttgcatcgtttccgagatagccgcgacggttgaggtaggtatccaaatgcttgccaaggcggtcaatggccgcaaacttgatttggctaccagcaagggcgattacttccacgacaatattggctgaagtcgttgctgcgccgtcgcccaaactttcaaagcgttctagataattaagcttggcattttttccagcgatgatgaggacacgtttattaaaagcaactggactagtgctgtcttggtagaaaagggcctcaactggctggtcgatttcaacattatctggcacgtagaggacagctgttgcgttaaaataggctgtgttataggcggctaatttgtgttcatcgtaggctacggcagcgccgagatacttttcaagtacatctggaatgacatccatagccgatgcgaagtcagtaaagactacacctttctctacaagggcaaccggcaactgttctagaatcgtttggctgccaacttgaaccaacataggattgtcaccgatagctgtaaaatctggaactgccccgatttcatcatttgtagctaggcttccgtcacctagattccaacggtgaaacttgacccgctcgataaccggcaagtccagctctgctattttgtcaaaagccttaagacgcaggtctgtcaaccaagttggttctgcctgcaaggctgaaaattcttgaatcttttctttggtcatagcttcctccaaagacttaaatgtcatcttctttgtagtcgatgccaagctctgctgcgacttggacataaccttctttttccaagcgttgtgccaattctggtccgcctgacagaacaacacgaccttccatcatgacatggacaacatcaggagtgatgtagttgagcaagcgttggtagtgagtaataatcatggcaccaaagccttcaccacgcatagcatttatcccctttgacacgactttaagggcatcgatgtccaaacctgagtcaatctcatcaagaagggcaaaagttggttccaacatgagtaattgcagaatctcattgcgttttttctcaccacctgagaaaccttcgttgaggtagcgctctgccatttcctctttcatgttaaggagctccatcttttcatccaacttagtaatgaaatcacgaacagaaatcttgtcttcgtcttccttaccagcgttcattgcggcacgaagaaattccgcattagtaatccctggaatttctgacgggtattgcatagccaagaaaagacccatacgggcacgttcatcgacttctaattctaaaatattgacaccgtcaaacagaatctcaccttgggtaacttcataacttggattccccatgatggctgctgaaagggtggatttccctgttccgttcggtcccatgatggctgcaatttcacctgttttaagggtcaaattcacacccttcaagatttctttgccttcaatttccacatgaaggtctttgatttctaatactgacatgctgtgctccttttcatttttgtcctcttcaaaaaccacattaactgaccaagctaactagatacaccgataagactcaactttggcagtggggaaagagctcgaccattcatagaagagtccgtcaacaagtcctagttttaagttgttgagctgggagtgggaaagaactcgaccatccatagaagagttcgttttcccacccccgcacagttgattaggtcagatttggagtgtaaaacacgaacaaatctgccaatcaaccactactgcgctaagatgttgacactaacgttgagaagcggtacagggcttgagcccagcttcactccactggactgttaaacccaatcaaccactactgcgctgagatgttgacgctaactttgagaagtgatgcggggcttgagcccagcctcttttcttgttaatgatgattttcagagagtgttaatctataaaatagtcttttctgacaattttaattaaccatatccactatattatatcaaaaaaagagcctgacggctcttatcttgtttagaaagattcttattttctttttttctcttcacagcactttttatactttgcgattttttcttgacggtaactactattaccaataaaccgaagaagattgagcaatggagttctattaataccaaagatgccaatcaattcacagagaatctcaatccccagtcccatggtcaccaataggagaatcccccctattctactcgaaacattgagcaaaagagaggtcagggagaataagaaagagatggcgtaaatcaccaagactgtgccacgatgagtaagtcccagagagagcaagcgatgatgcagatgcatcttatctgcttcatagattttttgcccagacaattttcgacgaatgatggctactacagtatccgtaataggcactccaagaataatcatcggagtaaccactgcaacagctgtcgaatttttcagtccttgaagggacaagactccaatcataaacccgatgaagagggcacctgtatcgccaagataaatgatagcaggattatagttatacggtaaaaaacctacaatcgccgcaaccaaaacaaagatggttaaggtcaaaaaaatattgctatcatgcaaaaagaaataagacacaattcccatcgttgtcagggaaataatcgatactcccgaaaccagaccatccagaccatcaatcaagttgactgcattcgtaatggaaacaatccaaaggaccgttaatagaaaagagagccagacaggaaattgaaggaaaggtcctccaaaaggaatcttaaagctatcaaaacgaaattccgtaaaaatccaaataatcgtcgctgcagctagaataccaaacattttaggagcaggctttaactccttgacatcatcaatgaatcccgtaagaacgataatgctggatgctaggaccaggggccagatataatgcaagtaagtgccatggtaattgacacgggtaacaattcctggtaaaaaccataggacagaaatggtaaatgccacaaagatagccagacctcccgctgaaggcatgggcaccttatttattcgccgtgcattgggattatcaactgctccaaccctcagggacataaaacgaaccaagggggtcgcaatggctgatatgaccatggttgtaataatgaccattatgtattttagagcaaaaggaatcatactgtcggaaccttcctaagctcctcaattgccgcaagcggaagcatcaaagttccgtgttcttgtaaagcaggtctggtcaacttagtatcattggtaaattccaacattcttgagagaatgtagcctggatactgcttggaacgattttctacattgataagaactgtcaagtagtagtgaccatccattttatataattccgattcttctactggataatcaaccgtaccaacaaaagtaaacagatcctctatcgttggaaattccaaaatatagtaaatatagcgctcctgctcctcttcatctgcttcttcctcttgctctacctcttccaaatgacgaacagctgttgcatccggtgcacttttctcacgaacggtttgctccaaactcttgaaaaactcatctggagtcatacttgcgacatcaccaagttccgacaaatctgtaaattcatcaaaattcaagttctgatccaaatcagatttggtaacaaagatgtccacccgatctggcttcggagtcacacgaaaactcagcataccgctttctcggaaagtcattggtaaatccaattcatccaaaacagtgtaaaagaactcctctgtcttttcttgcggaatgagaaagtccgaaagttccattcctctctcttccaaatcatctaattttatagtgattttcaaggttgaatcactaatttgctttactttcataactacctcattcattgattcatcaattttttaaaattgattgatcattttcaatactcatacatatcttccaccattatactaaaaccaagctcgaaagacaaaagaaaagcaggtctccctgctcttaaaataaaaatgtgataaaggcataaaccaataaaatcgcccctaaaatgatgcggtagtaaccaaagaccgtgaaatcatgttttttaacaaagtctgtcaagaaacgaataacaactaaggataccaagtaagccgtcacactagcgactagcaagatccatacctgctccatattcaggctattgccatctaagaaatatttaacagccttcaaaccactataaccaaacatggttggaatcccaaggaagaaggtaaaatctgccgccacagatcggctggtccccaaaataatcgctcccagaatggtcgcacctgagcgactagtccccggaacgatgcttaagacctggaaacacccaatcaacaaggcagttttataagacattttcgctaagtccgtcacctgtggctctatacctctgttacggttctcaatccaaataaaggcaataccgtagacaatcaaagcaatcgcaatcggtaccataaaattgaaatgtgcttcaaaccaattatccaacgggactgcaattaggatggacggaatacaggcaatgacaaccttggcccacaattgccaagtcaattgaatatcacgcttggtttttccaggctgaaatggattcaattttttaaagtaaatagtcataactgctagaattgctcctagctgaatgacaatattaaacatttctaggaagttcttactttggtttaatttcacgaactcttgaaccaaaatcaaatgccccgttgaagaaactggcaaccattccgttaccccttcaatgattcctaaaaatatagccttcaacaattccaatagcataaaaagctccttttcatcaattctctacattatatcataaaaaaactccctattcatagtacaaggatattgaaatttgtcagaatttttaataaaatggtgtaatagcattttaaaggagacactatgaaacgtaaactcagtatatttctgctgaccctaatcgctgttttttctgtaacaacaggggttcgggcagacgaatacctgcgggtcggtatggaagctgcctatgcaccatttaactggacccaagaagatgatagcaacagtgccgttcctattgagggaaccaatcaatttgccaacggatatgatgttcaggttgcaaaaaaaatcgctgcatccatggataaagaactcttggttgttaaaaccaagtgggaaggcttggtccctgctcttacatctggtaaaatcgatatgattatcgccggtatgagcccgacagaagagcgcaagaaagaaatcgccttctcagatagctactacacttcaattcctaccctggttgttcgttctgatagtcagtacgcaaacgcaaccagcttggaagattttgctggcgcaaaaatcactgcccagcaaggggtttacctctatgatttgattgaccaaattgaaggggctaacaaacagactgccatgggagatttctcacaaatccgtcaagctttagaatctggcattatagacgcctatgtttctgaacgtccagaaggtcgtacagcagaagctgcaaataaagctttcaaaatggttgaattggcagacagttttgaaaccaatgccgaagacgtgaccattgctgtcggtatgcgcaaagatgacgagcgtatcgctcaggtcaacgaagtcttagcaactatttcagaagaagagcaaatcgcacttatggatgatatgattgaaaaccagcccgttgaagaagccagcgagggcgaaacacctagtttcttcgcccaagtttggaatattgttgttaacaactggcaacaacttctgcgtggaactgggatgacattactcatttccatcctcggtacaattatcggtactgctatcggtctcctcatcggtgtcttccgtacagctccaaaagcagcaaacaaggcgcttgctattggtcaaaaagtgctcggttggattatcaatatctacatcgaaattttccgtggtacgccgatgattgtacaatccatggttatttactatggtaccgcccaagcattcggactcaatcttgaccgcacacttgccgctatcttcattgtatccatcaacacaggtgcctacatgagtgagattgtccgcggtggtatctttgccgtcgataagggccaatttgaagctgctactgctctcggatttacccataatcagaccatgcgtaagattgtccttccacaggttattcgtaacatcttaccagcgactggtaatgaatttgtcatcaatatcaaagatacttctgtattgaacgttatctcagttgttgagctctatttctcaggaaatactgtcgcaacccaaacctatcaatatttccaaacctttacggttattgctattatctacttcatcctaacctttactgtgacacgtatcttacgcgcagttgaaaagtattttgatacagatacatacacaacaggtgcaaaccaaatgcaagtcgaggtgccacatgactaaaaatgtaattcttgaaatcaaaaatctaaagaaatcatacggacaaaatcaagtcctcaaagacatctctattagcgttgaaaagggcgaggttatctcaatcatcggttcatctggttcggggaaatcaaccttcctccgatctatcaaccttttggaaacaccaacagaaggacagattctataccacggacaagatgttttggctaaaggatatgatttgacgacttaccgtgaaaaactaggtatggtattccaatccttcaaccttttcaacaatctaaatgtattggaaaatgccattgtagcacaaactacggtactgaaacgagatcgagctgaggcagagaaaatcgccaaagaaaatctcaacaaggttggcatgaccgaacagtactggcaagccaaaccaagtcaactctctggtggacagaaacaacgcgtggccattgcacgtgccctatctgttgacccagaagttatcctctttgatgagccgacttctgctctcgatccagagatggtcggggaagttctcaaaaccatgcaagatttggcaaaatcaggattgacgatgcttatcgtaactcacgaaatggaatttgcccgtgacgtatctgaccgcgttatctttatggataagggtgtcatcgccgaagaaggcagccctcaacaaatctttgaaaatccacaggaagaacgcacacgtgaattccttcagcgttttcttggataaactcaatctattccatagaagactattacttaccagtttcaaagctggtaagtttttttagactaaaaaaaagaggaattcgtaaaattcctctttttggacatctctaaatgaaaccatttagattagttttcaaatttcttgtggtttttgtcgtaaaaatcaatcaaacccaaggcagttgcaaatgaaatattgtcaatcttagcgcgaccttgtgcaagagcgataactgacatttcacgagcatttgtttccttactgatacggtaacctgtgattttcttttcacgaacccagccgacaacagcggctactttttcgtaactagtcattagaaacccctttcttttttattcgtgcaatttagtataatatgttttaacctattttgtcaagtaaaatgttcgttttttaccatcattttgccctaagagatgatagtatttgcgtccttatgtcttcgaccccctccggattccccggaaggaagatagtttgattacctccttgtgcaaaattattgagagtatccaagtattggttggtcagcaagatagacataatctgctcttcagataggctaacatttgattctttcagttcacgaatcgaatctgccagtccgtctacaatcgccttacgttgttgtgcaatacctacaccatgcaagcgatccttttcagcttctgcttctgctgctgtgacaatttttatcttgtcagcttctgccaattcttgggccgcaacccgtttccgttgagctgcgttaatttcattcatagattgcttaacctcggcgtctggctctaccttggtaattaaggttttgacaataacataaccgtaggttgacatttcttctgctacttgtttttgtacctcaagtgcaatctcatcctttttctcgaagagctcatccagtgtcaatttaggcacagatgaacgcagggcatcttcaatataggacttaatctgtgcttctgggtgcatgagcttgtaataggcatccgtcacattattttcatttactcgatattgagttgccacattcattgtgacaaaaacgttatcctgcgtcttggtttctaccacaatttcactttgcaacatccgtaattgaatgcgggctgcgatgacatcgactccaaatggtattttaaagttaatacctgaagtagatgttttttggtatttcccaaagcgctcaataatagcgaccgtctgctgcttgacaacgtatagccctgaagcaatcaaaatcaaagcaatcagtacaaagaacaagaaactaccaataaaaacaattggaccaaacaccataatgacctcctaaactagcattttataaagcgaatcattttcatgaagattgatgtactggggatcaaactcttccaagcgagaaataaactgcgtataatctgttttatctcctagggcaataccgattagaaccggtcctgttcccttattggcacgtttgatatattcaaaacgagtaatatcatcatttggccctagaatatcatttacaaattcacgaagagcccctggacgttgtggaaaattaacaacaaagtagtgtttaattccctcgtagataagcgcacgttcctccatttccggcatcctgttgatgtcgttattaccaccagaaatgatacaacaaatggtttgccccttgatttggtccttgactacctcaagagctgcaatcgttgctgctcctgctggctcagcaacaatacccagcttagaatagaggtctaaaatagtcccggaaatccacccttcatccacaccaatcaggcgatctacgtatttccgagccacttcgtaggtcgacttaccgactttctgtaccgcaataccgtcagcaaatttatcaatttggtctaatttaaccggacgacctttatcaaaagccgctttcattgaccgtgccccacttgcttcaacaccaacaatcttaatttcaggtgcatgttctttcagataggccgaaacgcctgcaaccagaccacctcctcctatgggaactaaaatttggtcaaaactaatggtttgctcttccgcttcttccaagatttcataggctactgttccctgaccagcctgcacattttcatcatcgaatgggtctataaatgttttcccactttcctgagtataatcttgtgctgccttggctgactcatcgaaggtatcacctacgagccgaatctctacataatctcctccgaaaaatttaacctgccctattttttgttgcggagttgtaatgggcataaaaatcgtagcaggaatttgcatttcctgacaggtgtaggccacaccttgagcatggtttccggccgaagcacagaccactccgcgtgacttctcatcatctgtcaattgtgaaatagcataataggctcctcgaattttaaaagagcgaacacgctgttcattttctctttttaaataaatagttgcaccatatttttccgacaagtatcgactataatccaagggggtacgtactaccacgcgcttaagaacggagtatgcttgttctacattttttgctgtaatcatagttccattaatttctttctatatttattgtatcaatattccctagaaattcctagtatttaaactattattatgtcattttataaaaaccgaacttttttatttttttaatgtattcatgaatgaaatgggcaaaagagccggaaaaaaccagctcttttattcattttcagagatagggaaaaaagggaatgacatcccctcatccgccaactcaaaccttaaatgtattgccatcactcaaagtaaagctgactatcctcctatccaccatgatagtgtttaattatagattttgaatgcgtcgtcatcattgcgtccgacaaatggcattgctttgcggagctctgcacctactttttcgatttcaagattctctgcttctttacgataagcttccatacgtggacggcctgctttatagtcatttacaaagtcatttgcaaatttaccagattgaatatctgcaaggactgccttcatgttttctttgacttggtctgtaatcacacgtggacctgatacatagtcaccaaattcagcagtgtttgagatagattggcgcattttcttaaagccaccttcgtagacaaggtcaacgatgagtttcatctcgtggagaacttcgaaataagccaattctggtgcataacctgcttctgtcaagacttcaaaacctgcctgcataagggctgtcaaaccaccgcagagaacagcttgctcaccaaacaaatcttcttctgtctcttctttgaaagttgtttccaaaagaccaacacgggctgaaccaacaccttttgcccagtccatcgcaatatgttttgcattgccagttgcatcttggtaaacagcatagagggctggtactccaaaaccttcttcaaaggtacggcggaccaagtgacctggaccttttggtgcacacatgaagacatccacatctgctggtaccttgataaattcaaaatgaacgttgaaaccatgggcaaaaccaagggcattgcccgcttccaagtttggagcgatttcttcattgtaaaggtctgcttggatttcgtctggagccaagatcatgataacatctgcttgttttgctgcttctgctacttcaaaagtttcaaaaccatcttcttttgccttgtcaaatgacttacctgcacgcacaccgatgatgacatcgtgtcctgtatcacgcaagttttgagcatgggcatgaccttgtgaaccataaccgataacggcgatacgtttaccgtcaagtgctgctactgttacatctttttcatattgcattgttactgtcataattttttctcttttctatttttatttgtagttttggatgttcaaagaaaatgaaggctagactaggcgatgtaggcgaagatagaactaacgtccatcaagccaaatcaacgcaggataggtcttattatcgaaaaggattagtctctactaaagccagtcgcacccgttcttgcgatattcttgatgccataaggctgaatcacacgcaggagggcgtcaatcttatctccatcacctgtcatttgaatggtaatggagtgaggtgctacatcgacaacatttgctctaaagggttggataatcgctaaaatttctgctcgttttgttggcggagctgagattttaacaagaatcacctcacgctctaagtggggaatgtccgtcaaatcacggacacggaccacatcaatcaagcggtttagctgtttgatgatttgttcgacctcatcgtgactgaccacgtctacaatcaccgtcacacgtgagatgccatctacttctgttgggccgacggagatggactcaatattgatttggcgacgagataggacacctgtaaaacgattcagaacaccagatgaatttcgcaatttagctgttaacattctacgcattgaacttcacccccaacatttctgcattgctcttacctgctggcaccatcggttgaacatgttcacgattagaaatatgaacctctatgagcattggtttatcttctaagataactttcatatcttcacttagagtcgctggattgtcaaaactataatgactaattccgtaggcctctgccaacaattggaaattcggttcatcgtcaaagacagattggctacgacgcttttcatagaaggattcctgccattgacgaaccattccaagagagtggttattgatcaacacaaccttaatcggtacaccatagccattcaaaatagccaattcttggttggtcatttggaagccgccatcaccaacaaagatgattacttctttatctggattggctaatttggcgccgatagctgcaggaataccaaagcccatggttcccatgccaccagatgttacaagttggcgtgcatgtctgtaggggtagaattgagcggcccacatttgatgctgaccaacgtctgttacgacaatggcatccccttgcgtcaactgaccaattaattcaattgccgcctgtggcttaataaccttttcatcttcatcataccaaaatggtgcccgacgtttgttttccaatacttgtgccgtccaatcagcatagcctgtttcgactgtttctaaagcaagcagagctttcaaggttgccttagcgtcgcccactaccggaatagccgttttgacaactttaccaatttctgcgggatcaatatcaatatgtgctaccgtcgcatttggcgcataggttgttggatttcctgttaggcggtcatcgaatcgcgctccaatattgataatgtaatcagcctgatccatagccatattggcagcgtatgaaccgtgcataccacccatagccaaggataattcatgctcaatgggcattgcacctaatccaaggagggttgaaactactggaatacggtagcgctctgcaaaggcaactaattctttattggcatctgcataattgacaccaccaccagccaatataactggtttttgagcttggctaagctgtttcaaaattttcttaacctgcaaaccatttggttcaatcgttggctgataacttggtaggtgtagagttgggtcatgataaaaatcaacaactctttcttggatatcttttggaacatcaataacaacgggacctggtctccctgttgtcgcaatatggagtgcttctgtgatgactctaggaatatctgccgtatcccgaatttggtaattgtacttggtaatcggcattgtcatccccaagacatctgcttcctgaaaagcatctttaccgataccacgtgttgcgacttgaccagtaaaaactaaaagaggaacactatcacccattgcgtccgcaatcccagtaatggcattggtagcacctggtccagaggttacaatggctacgcccacctttcctgatgatttagcgtatccttcggcctcgtggaccgctccttgttcatgacgagccaaaatatgctggattccctcatattgatagatagcatcatatagaggcaaaactgccccaccaggataaccaaaaacaaggtctactcctagctgatgcagagtgtccaaaatgagataggaccccgaacgtggttggtctagttgaatttcttgcacgaatattcctcctctctgcaaatttgttatctactataatatcacaaggaagtagaatgtcaagaaattttctgaaaattcctacatttgttcgttttcttaactatttcctaacatttcttaagcaaaacttaagcaaatcccttgactggcttggtttcagcttgctttcagaaaacatcagtatagtagttccactaaaaaaattaaatgaggtttaggatatgtattatgtagtgataccggcttaccagccagatgaaaaattaatccaactattaaaaataatgaaaaacaggctaaattgtcaggtcatcgttgtggatgatggtagtactggcgcatccaaaaatattcttgaaatcgccaaaacctatgccattgttctccaccatgatgtcaataaaggaaaaggccaagccttacgaacagcctttagtttcatccaagatttgagaaagcctggtgtcgctgttaccgctgattcagatggtcaacacgctgtgaatgatatagaccgtgtcgcacgcgcagccatgaatctaccaagccgcctcatccttggtgttcgtcaatttactaaagacatcccgctccgtagccgatttggtaacaaactaaccagagtattgtttagattgcaaactggtgtcaatgtgtccgatacccaaacaggcttgcgtggattccatactgacttaattccattcatgttagatattgaaggcgaccactacgagtacaagatgaacatgttaactcaggcaagtcaacgctataaaattacggaagttccaattcaaactatttatatcgatgataatgccagttcgcattttcgtcccataaaagatggactgctcatttacaagaatctcttcaaatttgccctggcatcttttggtggatttctagttgactacggaatatatgcacttgccttattgctactcactagcttaccaactgctctacgcttattggtcgcaaacacgattgctcgcatttgtagcgctacctgtaattttgcacttaataagaaattagtctttaacaatgaagagagcatcgcacgaacaggcgtaggctactttacactagcccttgtcctcttcctttgcgatacagccctcctatatctcttccaccaaattctaggactcaacctctacattgtcaaacttgcagttggtatcttccttttcctagcctcttggttcattcagaaaaatatcatctttaaagaaaggaaatcattttcccatgaaattgcttaaaaaaccctttgcctacgcatccatcttcggaatgcttttgacaggaggttttacttactccatgttaaaaaccttcgtgctttccgaggctatcacaacggttgctgcaagtaatgctacttctacgagcgagcagaatacaactacagcttcgtcttccactactgccacaacagcaacgaatgtctctacaacggatactagttacactgatgacaatatccaaatcaacttagagaccatcactaccaacaacacaactgtttacgtcgcagatattcaagtcagctctccagagtatttaaagacagctctagcccaaaatacctatggcacgaacgtaacagctaaaacttctgaaactgcggcagcaaacaatgccattctagcggttaatggtgactactatggagccaattcaactggttatgttattaagaatggggttctgtatcgagacaccgttcgggacaatgcagcttatggcgacttggccatctacgcagacggctcatttgaggtcatttatgaaaatgagattaccgcccaagaattgattgacaagggcgttgtcaacctcttagcatttggtccatcattggtcgaaaacggcgaaattgtcgttgatacatcaacagaagtcggacgtgcaatgtcatccaaccctcgttctgctatcgggattatcgatgaaaatcattatatcatcgtcgtagcagacggacgtacgtctgaaagccaaggactctctctatatcaattggccgaagttatgaaacaatatggtgctcaaactgcctacaaccttgatggcggtggttcatccactctttattttaacggtcaagttattaacaacccaacaacaaatggaaatactatctcagaaagggcggtgagtgacattgtctacatcggttactaattcaactacaagagtttcaagaacgtttatctcctacttagcaataacagctttcctgtttattttcagtcgaatctatgaaagtctcagctatggcgaagtctctgtctttatgcattatatgttctgtgtaccattaataggcggagctgtgctactcggtttgctgcaacttatacctactctttcacgtctctcttataatttgtggaattctggcgttgcaactattacagctggttgtcttctccgaggcattatcaacctatctggacgttcaactaccttagatcaaccttattggtacatcggcgcagccttcctagttctatcgttagtcggtcttttcatcaatccatccgcaaataatcatcgaaaaacgacctcttaatctacaaataaattataagggcacttaacattcttaggtgccttttactgtagaataaattgttgaaaaattcggaaatttccaattgtttatcaaatcttttatcgtttctttcatatctatgatataatgggtaaaataagatagggagaagaaaattatgaccgatacaaacaaacttaaagactttcgacatcgtagctctgtttacgattcgatggtcaaatcgcccaaccgtgctatgttgcgtgccacaggtatgaccgatgatagctttgaaaagcctattgttggggttatttcgacatgggctgaaaacacaccctgtaacatccaccttcatgactttggaaaattagccaaagaaggtgtcaaggaagcaggtgcctggcctgtccaatacggtaccatcaccgttgcagacggaatcgctatgggaactcctggcatgcgtttctccttgacttcacgtgatatcattgcagattctattgaggcagccatgggagggcacaacgtggatgcctttgtcgcaatcggtggctgtgataaaaacatgcctggttccatgattgccatcgccaatatggacattcctgccgtatttgcctacggtggaaccatcgcaccaggaaacctcaatggcaaagatattgacttggtttctgtcttcgaaggaatcggaaaatggaacaacggtgacttgactgctgaagaggttcgtcaaatcgagtgtaatgcttgccctggacctggtggttgcggtggtatgtacactgccaataccatggctactgccattgaggtaatgggcatgtctattcctggctcttcttctcaccctgctgaatctcctgagaagaaggctgatattgaagaagctggtcgtgctgttgtacgcatgctagaacttggcatcaaaccatctgacattatgacgcgtgaagcctttgaagatgccattacagtcacaatggctctgggcggctcaaccaacgctactctgcacttgctggccattgcccatgctgccaacgttgatttgaccttggaagatttcaacgatttccaagagcgtgtgcctcatttggccgacttaaaaccatctggtaaatatgttttccaagacctctataatgtcggcggtgtccctgcggttatgaaatacttgctcaaaaacggcttccttcatggcgaccgcatcacatgtacaggtaaaaccgttgctgaaaacctaaagaattttgcagacttgactccaggtcaagatgtcatcatgccacttgaaaatccaaaacgagcggatggacctctgattatcttgaaaggtaaccttgctcctgaaggtgccgttgccaaggtttctggtgtgaaagtccgcaaccatacaggtccagccaaggtctttgattctgaagaagaagctatcgaagcagtcttgactgacgaaatcgtagatggcgatgtagtcgttgtccgctatgttggaccaaaaggcggtcctggtatgcctgaaatgctgtccctttcttctatgattgtcggaaaaggccaaggtgacaaggtagcccttctaacagacggtcgtttctctggtggtacctatggactggttgtgggacacatcgcacctgaagctcaggatggtgggccaattgcctacctccgtactggtgatttggtgacggttgatcaagataccaaagaaatcaccatgcacgtttctgaccaagaaatcgaagaacgcaagaaaacaactgttattccaccactctactctcgtggcgttctcggaaaatacgcccacactgtatcctctgcctctaaaggagccgttaccgacttctggagaccagaacgtacggggaaaaaataaggaactcaacgaccctgtcctcgcggtagggttttccaaaaggagaaaaaatgaaactaaacgtcgaactctcccgctttcgtgttaaagaaggcaaaaccgttcaagtagatgaatggatggcctttctcaacgagcacatggaagacacccttctcactcttgaaggagagaaaatgtatgtcgaaaccatcttccgtgaggtattggacggacgcgaatacctctattggtactctgtccaagccgaaggggggattgaagtcgaagattcagaatcctacatcgacaaaaaacatttagaatactgggaagaatgcattgatccaagctatggtatggtcgatctggatcctcaagtccttatgattcccaaacccatttatgaaacgatggaagaattagacagacaatacgatgacacgtttaaaaaagagctgcagtaaaataaaactgcaactcttttatttagggcttatccccagagtaattcgacctaagcgactaattcttgtcattttccaagcaggagaccaaacaatctcgacctgagcatcttctattccgtcaatagtcttcaaagctgctactaactctccaggcatcgtatctgcacatgagcaacctgcatcagtaaaggtcataactactttacaaaacccggtttcatctagatgaatttcatagacaagtcctaaattgtatatatccaactcaatctcggggtcgtgaatggattccaatacctccaccaattgatctgacaaaataagggctcgctcattgatctgaatatcttctctcatttatccaaacactcctaaaacatttataaaaagtattgtatcataattatttgaaatatacttgtcttaccaaatgttttcaactagttttcaaagtgcacgaacctctgaattctcaccttgaccaatagaaaagatatacttatgaccttgagtcaagctatgatagaagccatgaccagcataaatctgaaatacttgcattgtatcactagactcatctttatagatatgttgataataaggattatccgcaaaaactgtctttagatagtcgttctccacaggtctagcagccccttctacacacacgcactacctggataaggtacccttcctcagaaatagccgtcatcgcaactctttgatcccccatcaattgatcataaaaatgcgtttctgggcttgtcataaagaaaatcccttcttcgtttgctgcagtgatatgagcatgacgagcatgtggatttccatactcatccaaagtagcaaaaaccccaaccttcatatcttccaaaatatgcataatatcttttagttccatggtatcaccccttgaaaacacctattttctaaagtatatcaaaaacaagcgaaaatgttaagtggaatattgatagaaatagtgaaagtgtttcatgaacaactccctactgacggaaccatttaagaaggtagctatgtttgcttcattttcaaccttcaaaggttcctgaacccttttgatttccaattggtatggatttgactctgaaccgattatgacatcaatcaaaatccgttgtaactataaaaactacctaattataaaaaagcgactcttgagtgctttgaaacgttgatatattgcggtatattaacgtttactaaactggcttgctttacgtgctttcttaagacctggtttcttacgttcaaccatacgagcgtcacgtgtaagaagacctgcgcgtttcaatgaatcgcggaagtctgggtctacttgaagcaatgcacgcgcgataccgtgacggatcgcacctgattgaccaccgtaaccaccaccgttcacgttaacgaaaacgtcgtatgaaccttgtgttgaagttactgcgaatggttggttgataaccaaacgaaggtcagcatgtgggatgtactcttctacatcttttttgtttactgtgattttaccagtacctgggaccaaacgtacgcgtgcaaccgcgtttttacgacgaccagtacctgtgtattgtgcttgtgccatttagattacgtcctttcccttagataagacctgaaatatcaagtacttctggttgttgtgcagcgtgagtgtgctcagcacctacaaacactttcaacttcatgccttgtgcacgaccaagtgtgttgtgtggaagcatacctttaactgatttctcaatcaaacgaacagcgtttttagaacgcaattcaccagctgagattgatttcaagccacctgggtggtttgagtgagtgtagtagatcttatcagttgcttttttaccagtcaatttcactttctcagcgttgattacgataacgaagtcaccagtatcagtgtgaggtgtgaaagttggtttgtttttaccacgaagaacgctagcaactactgctgaaaggcgtccaagaggtacatcagtagcgtctactacataccatttacgttcaacttggcctggtttagccataaatgttgttttgttcatgatttctcctatacgaatcgtttttgtttactgggcggatgttccggtccgcgggtatttggaaggttccggggcctttcaaatggggtaaacaataccatctaccattttatcaaatctactagtgtccgtcaagctattttactttactttttttattttttgaaagatagcagagctgctgagaatgaaagccttatccattttaaatttcttactgccctagttgtccaggcaagaccagcttctccttataaggaaaggttttatcaaattcttccaagaccaattcatccaccgtatagaccagaggacctgtaaaacaccagtttcagccatccaaggcttctggttggaacaacttgacaatgagcattatcgtacctccttttgattaccctattctacataagtcgtcatcacacaaaaagggacacatctttacaagaaatatcccttagaatctaggctctcattgctgtaccaattgataaaatagctaagactcctgtccctgtatgagtggcaatcacaggccctaattctgtcaatagaacatcagaaatacggtcgtcttccaataaactagatttgacgccctctgccgcctcaatatcacctgtataggccaccatgaccgtagaatgatccaagttgtccaaggtcaagttcagcatttccttaattccttttttacgaccacggattttggcaatggcttctaacttcccttccgcattgagtgcaaggagaggtttgatattgaccaatccaccaatgagggctgccgctttagacaagcgtccacctcgcaccaaatgattaaggtcatcgaccaagaggtaggttcgtaaacgcggcaccaaatcttctacgattgccttggtttctgccagagtcttacctgcagcacgtgcctcaacggctttcatgactaagtagccttctccaatggtcgctgcctttgtatcaacgatggtgatgactgcttctggatattggtccataaccatatctcgtgcaataactgcactctggtaggtccctgaaagagctgctgagaaagcgagataaagcacctcatgatcttccttggctgccgcttcaaaaacttcttcaaactgaccaacattgacctgactggtcgtgggttggctgccagaagccattttctccagtaaatctgcagaggtcaagcggttttcaccgactgtttcataggttgcgccgtctaggttaatggtcaaaccaagcacggtcacatcgttttcttggacccagctgattggcaaatccgatgtcgaatcggttacgattgtaaatgtcactctttcatttcctccatcatttcttttaaggcttgaaaattcccatctgaccagggattgagccgtggggtgtagagttctacctggtccacaaacttgtccaagtcctttttgatgaccttggttctctcctctaactcacgcgccgaaacccgtaaggccccttgtgaaaagaccacccattgttcgttgaggtcgctggttgcgacggaaacctgcttgcgacggtcactattgagctgggcactgagtcgttcgatataactatctgccgtctcttcctcctctgtaaaaatgaccgataccttgaattcgtcatactgctggcgaagacctggcacatggtgggcatcaaagacacaaatcacctcaatctgttcaaaggctgcgtagtgagacaaggtgcgaagcaaggtcgttctggccgcatccaagtctccctttttaaaatcttgcttggtggcctgccaaaaggcaatcatgttgtagccatctacaatgagaactttttctttcatttagattttcttccgaaatacttcgtacatcagcacagctgctgctacgctggcgttgagagattggacatggcccttcataggaatggtaatcatctcatccacctgctttttgatattgctggagatgcccttgccttcgttgccaataataagagctagtttgccagctgtattccacttgtggcttggagttccgttcatatccgtgccaaatacccagaaaccagcctccttgagcttatcgagagtttggctaagattggtcactcgggcgattgggacatgggccaccgcacctgttgaggtctttgccacaacgggcgtcacgccaactgctcggtgcttgggaatgatgatgccagctacctgagtggcatctgcggtccgcaaaatcgagccgaagttgtgggggtctgtcagaccgtccaagatgagaatgaggggattgtcttcctgctctgctttttccagaatcaccgacaggtccgcataggcgaactcagagacccgcaggacaaagccttggtgaacggcaccttctgtcatgtcagacagggtcttcttgggcgtccaagaaatcgacaccttcttctctgccgccagggccttgattttttcaacattttttccgcgcaaatcatcctggatgtagagcttgttgccggtgttagcctccaaactctccaccacagcatgtacgccatatacgatatcattctgttccatggttttattatagcatatttttgaaaaggaaaaagccgagaatttctcagctttcttagttcacactgttttccagataataatgttgggcaacataccagttgacacccccttgttccggatctgtatcatactcactagcttccaactccccacgactattgatccgataactccaatttcgtggctcaaaattagggtctgatggtacagttacatctgcataaactaaaccatcctcagccatacgaacacttatgacaacctggtcttttcgatacttttcaatcatgacgctacggctaaataaatcatccataacccaagcttttacctgatctgtcgttaagtttttggtatcaacctgcggtacaggattatgcaaatctgtcaacgaaatccaaccctgtcctgactttaatctgccccaactatgtccttccttttgagtcgtctcaactatcgtgtacgttccaggttctatattggtcacaacttctccagataaactaggttcctgacgaataaccagtccttgttttttaatatccacagtaaacaattgaacggcgctacctacctgagactggctagaagcttgcgaacttccagcagtcttactagtggctacctcactagttgaactatcctcaactacggtagtatcctttgcatctacatttttagcaataattaagttaaccgcacttccccgctttaccttcttcccactacttggagaagatacactaaccatcccaggctgaactgactgtccaccaacttctgttattgtaccaacttttaacccctcttcatacagtaaatccttagcttcagatagctcaataccatataattcaggaactgtaacttgagaaatatcttggtatacaaaatataagccagccattcctaacacagccacaacacttgaaatgattagccatatctttcgtctttttgcgtctgccaaacgtttctcagcttgctctctttgataattctcataatcttcctcagcttcgctaagcatttgctggatgacaaatcgttgactctcatccgtaacctgtgctaagtgcaatcgtaattgaaaaattctatccttaaactctttttcaatttgacgctcatgctctttttgcaaaatgttattttgtttttgaagtgctattgcttgagagttcatagcagaggtttgagcatccattttttgcttcaattcatcatgtctctgccgctcttcaaaatctcgcatccattgatccataataatcatctcctcataaaatattggttattatctacaaataaaatctattttattttagtatagcataacaccttaatttgtcaatcctcattttcaccccgtttcaatctaacttttgacaaatagtaaagcctatgatattctaacatctactatttgtccgtacaaacggaatcgaaaaaggagattttatgacacttatttttggaattgtggcggggctgattgcctttgctattggtggtttgtggtatggtttgattttccgcgatgcttggatcaaggcttcaggcattgacatggctaaggtagaagcagatcgtcaggctggcaaaaatggacagaaggaaatggtgatttcccttgtcattgaagtactgactgctgttgtggttattttcttcatcaagaccctcggtgtttcaccacttcatgcagctggtggcatgggcgtaattgcggtccttgcttcattgaaaaactacgtctttgagcaacgtcctatcaacctcatcctcatcaacgaaagctacaaactagtctgctacctagtagtcggtattctagctctatttgcataagtaattccctcctatccttaggaggtttttattttatgatacaatagaaatagactaaaaccaaaggagccctcatgtccctctccctccgcaccatcaaactgatatttgccaccgttctggctatttacctagcgaccgtactgggcctgtcttatacgacagcggcaggcatcatcgccattctcagcgtcctcgacacccgcaagtccagcttcaaaatggcccgcaaccgcctcttttccaccctcctggccctgaccatagcagtcctgaccttcgccctctttggctttggcatctggaccctgggcatctacctagcactctacgtccctctggcctaccgtttcaactgggaggctggcatcgccccatcgaccgtcctcgtcacccatctcttgctagagcaagatatttcgctgatttttttgggaaatgagctgacgctttttctgattggggcaggactggcactcttgttcaacctctatatgccctcgcaagaaaagaaaatccaggcctaccatgaccaagtcgaagacctactcaagcagattctcctccgctttgaagcctttctgctcaacggcgacggacgaaacgaggcagaattgattacgcagctggataagaccttggatgaggccctgaaggtcgtctacctagaccgccacaaccagctcttccagcagaccaactaccaggtccattactttgaaatgcgggcagcacaaaacaaaatcttgcgaaccatggcaggaaatatcaacaagtgtttactggaaggcagagaaaatgtcatcctgtccagcctcttcgagcgagcagcccagcaactgagccgagacaactccgccaaggaactgctcctagacatcgaactattccatgccaccttccgcgagcgacctctgccacaaacaagggaagaatttgaaacccgtgctaccctctttcaactcctgcatgatatggaagcttttattcgcctcaaggttgatttttatgaagtctataaagaccaagaaccgtcaatttaagccgacggttcttctacttttccatgaaattcatctgatacttggttgtgcaaatgcacgaaagataggcccatcatgactgcattccctgcaactgcaatcataaattcttccttggaagatacctttcctagccaaatggagaggattaaaatgagattgtaaagaaggatagaaagagctgccaaacgaatttttttcagtagtgtcttcataggaacctcctgtaagtgttgggagtgggacagaactcgaccatccatagaagagttcgttttcccacccccgcacagttgattaggtcagatttggagtgtaaaacacgaacaaatctgccaatcaaccactgcgctgagatgttgacacgaactctgagaagtggaactgggctttttgcccagcctctttaataaaaataacaagtatttatgcgttcttaaccccaaaaaaccgccagattttcatctagcggtcaggtgttttatgaacgattttagaaaggttagacaatcgccttgcttgtttcatcatcaaagaaatgagctttgttgaggttgaaggtcaagcgaactttgtctcctgggttgtggtagtcgcgtgcatcaacgcgagatacaaactctgtgctacctactttagagtagagcatggtttctgcaccgagaagctccgatacaaccacttctgcttctacgatggaagatggataagtgtccaattccaactgagaagccttgatgtcttctggacggataccgagggtaaatgatttgccattatagcctttttcttccaagtgtttgcgacgtccttctggaagctccaccttgaaaccatctccaacaagaacgccatcttgaagcgtaactgtgaagaagttcatagctgggctaccgatgaagctagcaacaaacttgttaacagggcggttgtagagctcttctgggctaccgatttgctcgatacgaccgattgtacctgtgcctgctgggtttttagttgcagacatgataacgatacggtctgccaaggtcatagcttctgtttggtcgtgggttacatagatggttgtcgcaccgatacggcggtggattttagcaatctctgtacgcatggatacacgcagttttgcatccaagtttgacaaaggttcatccatcaagaatacttttgcatcacgaacgatggcacgacccatggcaacacgttggcgttgtccacctgaaaggtcagctggtttacgttctaagaattctgtcaaaccaagaatttgagcagcttcttctacacgttttttgatttcatccttgctgtatttacgcaatttcaaaccaaaggccatgttgtcaaatacagtcatgtgtgggtagagggcatagttctggaataccatggcaatgtcgcggtcttttggagccacatcattcatgagaacgccgtcgatgtatgcttccccttctgtgatatcttccaaaccagcaatcatacgaagagttgttgatttaccacatcctgaaggacctacaaatacgataaactccttgtccttgatgtccaagttaaagtcttcaacagagtagtgctcgctgtttggatattttttatagatattttttaaattcaattgaaccatgttcaatcctcgctttctttgatagttttattgtaaatgaaaacgctttatttttctaggtcaaggtgaacaaaaagaacacaatcttttgtacaagttgcacaaaagactgtgttactgaaatagtttactttccaaaaattcaatgagccctttgggattttcagtagaaaagggacgaagcgatgggtggcattctcaaaggctacaacgcttttctcatcattagctcctattagatacttaaatccatgataaccatgtagcaaactgccaaatccgtcaattccttgagctgtaatcccgtccaatcaaaccatttgtccaagcgatactgtagcgtatttcgatggatatagagagactgggctgccttggttatgaccgcaccttcttgccaaagagctacaatttccttttctagctgctggtgggcaatcaaactagcaagtccttctctcaaaacggggtggagttgacctgcccaaagatagagctgaccgaaggtaagcaaccgtgattgatggtggctgcttcgccaatggtgaaaaagggattgttcagcttcgattaattgcggccaagagtgtaccaatttggctggccagatttgccctaaaaacaatgtaattctcagaccaaaatcgaactccatggtagcaagggtgtcacgcagtatttctttgacgtcaaaaagaggtgcctgatgtagaatgaacaggtaatcttgtccattgcctgtatagtagccttggagattggggaggagtttggccatcatatcaagccaggctacctttccatcttcatcggatacgtggcctacatgagcatgaataacctgtagtttttccaaggtttgtggaagaggacctcccccttggaaatagcgtccccaaggatgaccttgttctgcgctcgagtcattcatcagcaagtcaatcagttcgatttctcgatctgtcaaatccttgcgatcgacggaaaaccaggtttgattagccagaggcaactggatacttgctccgttttctgtcttttcaaatacaagccttccttttggaaataggtgctgcaattcttcccttttgctcatctcgcctccatctcattctgtctgtaattgaccgattttctgtcggtaatttttgggagattccccacaaatgcgtttaaaaatcttatagaagtaaccgacatttgtatatccaacttgaaaacaaatttcttcgattcccaactgactgttcaagagaagctgttgcgctaccttgattcgctgatgattgagcaattctgcaaaagtatgcccggtctcttttttgataagttgacctaggtaaaccgtatttaggtagagatgagcactcatatctttcaaagacagttcctctgcaaagcgttcacgaacaatcgtaacgacttcctgtatatgtggactgtaagtggaactctcggaaatttttttcagataatgacaaaaatactccattagttgatgtaaatctcgactcgcttctacctttacatagaaatcttccaagcgctgatggtcttcttcattaaaatagtaaaacacatccgacatcatctgattaaaaaattgttttgttaggtagactgccggagtggtttcccgtaatttatcagccaaatgtggtaaaacatcaacgatttttgccaatcttcctgcacgtagaagcggttccatatctttatagagttcagtggtagtagccgttagatcttctgatagttgcttataaaataagcgcctctctaccttgtcaatcaactgccgtatggtcatcgtcggggtaacttcttctgtatatagactaccctctggtcgactttctgtcaactgaaaatagtagacttgatgtaaaatatttttttcacgacagtagcccattgggtttggagtctctctagcggcaaaccatgttttctgggagtgacttaagaactcactcgctgtcagggttcctgccaagaagcccttggtgtattccctatctgtctctttcttcaaggttggtagctgttggagcagcttagccagttcttgtttattgatgggcttaaggagataatccattgcccctagggagatagctttacgggcatattcgaattcttgaaaaccagacatgatgataatatgggtatcaggcgattgttctttcattcgtcgaaccatttctaggcctgtcatatctggcatgctgacatcggttaggacaaggtccacagtatgctgtgaaaaataatccagcgcttcttcggcattctctgccgtataaacaatctcgacattgtattcatgataagggagaagatgcttcatcccttccaaaatcatatattcgtcatcaactactaacatcttatgcatcatgctcatctcctcgggggaagacaccttcaaataagattgaatatgtcaccccttccccttctttagaatctaattctatctggtaacggtctccaaaatagagaagtaaccgctcgtgaacgtttcgtaatccgattgattgtgaccgattttcttgcgacagttctcgacttgccaagaggtgtttgtaggcttccagagtttctgcgttcattcccttaccattatctctgatgagaatttccatatcctgtccatgcttgagagctttgacactaagcgcattgtcttttcgtttgaggtctactccatggacaaaataattttctaccagaggctggattacaaaacgaggaatttcaaccctttcgcacccaggatccatttgataggcataggcaatggaacggggatagcggatttgacaaatgtagctatgtttttcgcaaaatgaaagttcttctgccaccgttgtcatttttgcctgtgtcacactactgcgaagcaagcttgaaaattcataaatcatatcccctagctcatccatctgcttgctgactgcatacatacggaaaaattccaaggtattgtagagaaaatgggggttaatctgggcttgtaaggctcgcatattggcatctttctgagctaactgcaagcgatagatgtcttgaatactctggtccatagcatccagcatctgattgatttctgatgaaataagatacatttcctgctctttattgtccgtctgtagacgaagatgcctgtcttcgccacgaatctgttgcatggtatcaacaatgtccagtacttgaacttcatatcgtttaaacacccttctcaggaccagtagtaaaagagcaacgagacaactacttcctagaaaaatgattccgactaggctgccaactttttcaatagcatactgctggtcaactccaactgcaatttgcaaatccccactcattcgataggagagcggaggtgaggcaacatctggtcgcagactataaaattcccgatccagagaatcttgaactctaacggtcatggggagatccgtcttacgttgaatatattgttcgagcaaatccgcatcgatggtgacatagatggtcgcaataccttctgttgtcgatggagaaaataaggtcatcgaaatactatgttgcggagccttgtaattttcggccgtgacctttttaccagactttaagtcagaggtagaaacaaagacagtatttgcatccatcggagcaatatcgactccttctacgaagggataatagagatagagagtgcgaacagaatcctgcaaggaaatccgtttgaccatcaggtgtgggtgactcagtaaccagacctggtactgagaaggagataattgaaaatagtgataaaggctgtctagacgatccctgtccgtaatgtagtctgctagataattcccaacccgtccttgataataatccaactcctcttttagaccatctgctacttcctgttgaatgcggatgcgattggtatcatactgataccagctgatgtaggaaagaatactggcaaagaaaataacaatcccaatcactaataaagaataacttttcaaaagagtatgaattaaaacttttttcataagtaatccttgtcaactttcttataaactggatcaaaggcatcatagagaaacaagagccataggaccggtaggaagaagaataaaatcaagggaagcttgaatagcaagaccccacagacgagactgcctaacaaaaatttgaccagggctttccaatcaagaaaaagcgagacagccgccaactgtaagcctgtttttagactaaattcaaaatgtacttgaagttttaaaaagagagcatagagtgcaaaaatatagaaaagcccaaaagcatttgtaataagaactgctggcatccaccaggtctggggcaattgaatcaagagccaaatgccgctaaataaaagaccaatcaataagaagacaagaccaaggccaaggttaagccgaataaaatgctctttaaaatagccaaacgcctctcgaaaattatacttagatgcatccatatgatagttatcgtagaggtaaactatcgttccatttgctggtgaaatgcccagcactacgcctcctagcaatagaagaaccaaatagatggcactcaatttcatgaggaagaacagaagagtaaaaagcctgtctaaccaccctaacattgtatattcctccttttttatctattttatcaaaaaatcggtgcttttctaccatttgtcaagttcatcaaggtatttgacgaaaaatattttgtgtctcgtcatccaaataaggaaattgttttattttggactaaagttacgtgtaaaaagtgcatacaaaaccaacaccttatgttgaaattttttgataaggtgttacaatgatagagcataaacagttttaccgattttgggttgaagcgtaatcgtaaaatttgttatgcataatgaggtaatacattgtccgaatgagacgatgtatggaggcaatcgtgtgcagcttcgttgaagtcgtttgcgattgtctttttcgtttcttataaaagtctgcgatatggcaaggattggtatgattggctgaagcgatattgtggatacacttgaacagaatctttctagcgtagggattaccacgcttggtaatgtgttccttagcgaggaagttaccagattcatagtgtctcaggtcaataccgataaaggcattgatttgattggcagactgaaaacggcgaatatctcccagttcaccaataatacttgttgcagtagtctcagctattccaggaatagagagcagaatgtcatattcaggtaatggctgagctagttccaccatttcgtctaagactgcctgtctctgttcagaaagtctaagcaattcttttgtatagtaacggacctcttccagtattggagaggttttcttgacggcacaataagattgattagctagtgctataagcttctcggctaagtaagccacacgcttgtcagaaatccgttttgaagtggacagacggatgctctttgagagttcatcattgcttaactcaagtacgcagtccttacaaggaaaagctataactaagttccagtattgttcgccagatggtgtcgataagatattttccaattcagggaaagtgacctgtaagaccttgtgcaggcggtttttagctcgaacaatatcctcggtcagattctgatagaaacggctgagatcccgcaagttttggtagacttcttcttggacataagtgggtttacgattcagcacaaattgagattgagccagtttttcagcgtcaatttgatctgttttccgcacacgcaagctatccagttgcttcttagcttctaagggattaagccgtgtataagcatagccattatcatctagaaaagtttggagacggcgagaatagacacctgttgcttcaaagatgatttctggcttatggacggttctcaaatcgccaagtagccgagcaaagccgatggcgtcattggatatggtatagccatgaactttctcaccattgactagaatggccacttctgaacttgccttactcacatcaatcccaaaaactactcgcatgatattacctctttgtcttgaatgattccttgttttagcgatgtcattttcaatactcgacgtctggcgtcccacatactttgataacattctttctaaaacaggtgtcttgccagtttttgttgcgacgtctagcgtcaaaagcaccctcgacttaacaagacacctctactttatcataaagaaaaagtagtgagtactttctcccgtcggagatttcctcactactaatcttagtatgtttttgtatatattaacataaaataaatacaaaagaggctgagcaaaaagcccagcgccacttcttagagttcgtgtcgacatctcatcgcagtggttgattggcagatttgttcgtgttttacactccaaatccgacctatacgactgatgcgaacagaattcgcttcatctccaacctcaaactgtctcccagacagtttgagctgtgcgggggtgggagtgaaacagtatggggatagactgtttcagctcaacaacttaaaacgaaaaattgttgacgaactttttttagaccagtcgagttctttcccactccctcttttcacacttcatcacctgtatcgtattatttatttgctaaaaactcatcgtattgtttttgcatttcttcttttacttttttgtaggattcttctgcttccaattttttcagcatttctggaacagcaacatcaggatccacagtaccagtattgatacttgctgcatattggctcatgatattttggatacttgtaatttcagtcttaactgcatcagcattgaagttgaagccaagaagtggagactcttctgcacctgccagcaattcttctgcttttttcacatcttcatctgttaccttgtcagtgatgtagagaatttggctgttacctgtgttccaagctgacatacgagtatcgcctttgtaaccatccaacaacttgatacgattttcagcacttgggtctttttcccagttgactccctctggaccaaataccaagccgttcagcaattctggatttgtattgataagggtcaatacttccatagctttttctttgttcttagatgtttttgaaatgacaaagtttgctacttgggtagatccgcttgtcttataggcagatgtgattggtttagaagtaatcttatagcctgcaactgttgaaaggaggctatcgccaaagtcagctggtccttgtgtttcttcacgaacgaaccagtttgctacatcaagtgagaaggttgcgtcagtagtcgctgcatctgccataatgtagccagccttatagtatttgtgaatggtacgaaggttatccatgtgacggtccacttcaaatgggtttaccacttttgtagtgtcgcctttcaagtcgatagcaaatggtaactcattcccagctggatattccaagccgtctgttgagggtttgctagattttacccaggcaaatggtgttacatctgcttctttttctttgatggttgccaacatgctttccacatcatcgtagctatctactttagaaatgtcaaaaccatacttatcaaccatgtcttggttgaaggaaagcatctgttgactagctacgttaccgatgacagggactgcgtagatttttccgtcgatggtatttcctttgatataggcagggtcaataatgtcatagagggccttgccttctttcttgtaaagttctgttaaatcagcataagctcctttttgcgcattgataatatagttgtctgcaaaggcaatatcatattcctcaccagatgaggtaataatggccattttatctttatagtccccccatgagatatacttgatgtctagatgggcccctgcttctttttcgataatcttattggcattttccaaaagaacatcgatgtttttcggtgcgtctccgatttgatacatgaggatgtttgtcaatccatcttctgttgtagtgctacttgatgcggtcttatttccagtcagactaccacaagcggcaagggcagctgcggacgcaagtgtcacgcaggagtaggcaaattttttccatgttttcatttggctgttcctttctatttttttagataatgaagtatggaatacgattgttaagatagagtgatgtctctactccttgactccgccaattgtcaaacctttgacaaagtaacgttggaagaaaggatagagacaggcaattggtagagtcgatacgaccacaatagccatacgtgttgcttctttgggaagggcccctgcaacttctgaggacatggccgctgctgcggcagcattttcagagagatattgaatgtttgcttgaattttcatcagcaggtattggagagggaagaggttatcgctctggatatagaggagagcgttgtaccagtcattccaaaaagcgagggctgtaaagagagcgattgttgcgatacctggtagggttagtggcaagcagatttggaagaaaatccgaaattcactggccccgtcaatcctggcagattcgataatagactcagaaatagtctttctaaagaaggacctcatcaccatgatattgaaaggagatagcagcataggtagaatcaaggctgccactgtatctttgagatttaaaaacgaggtcataacgatataggttggaatggtccctgcgctaaacagcatggtaaagagagccatcagggtaaaaaatcgtctgtatctgaaactgtttctcgaaatggcataggcgtaaagaacggtgaagaagacattcaggctcgtccctacaatggtcacaaagaaggtgataaagagggcttggagaatctgatcttttaattgaaagagatattcataacctgccaaactccattgctctggccagaaagaatagccgttgatagccaagcttgtctcatctgtcatagaaatgatgataacaaatatgaagggaagggtacaagatagggcaaatatccctagtaaacttgagaaaaatagatctgttttcttactaaatgaatgaatagaaacagaagtgatttgtttcttttttttcatactcccctcctagaataaggctgattccttatcaaagcgacgaacaatcaggttggtcactaccaccaagatacagccgacaacagactgatagagacctgccgcgatagccataccgatgtcccctgttcctgcaattccacgataaacgtaggtatcaaggacctgagtcacattgaagagaggacctgaatttttcggaatttgatagaaaaggccaaagtctgctcggaagatatttccgacagccagaatcgttaaaatagtcatcagaggcattaactgaggaagggtgacatagcggatgcgttgccatttggtcgctccatccacaatcgcagcttcatagtaggttgggtcaatgcccataatggttgcataataaataatactgttatagcccaaacctttccaaattcctaagaaaagcaagatgaagggccaataggttggtgtgctgtaccagttgatgggatccatccccattcctttgagaatattgtttatcaatcctttatctggactcaaaaatgcgtaaacgaagaaactgataatgacccaagaaaggaaataagggaacaaggttgtggtctgatagatctttaccagcttcttcgaccgcatctcactaaagataatggcaatacctactgcaaaaatcagtccgagtacgataaaaccaagattatataggatggtatttcttgtgatgatataggcatcggatgattgaaatagaaatttaaaattatccaatcctatccacttactttgtatgagactatcccaaaagccattacctgtatggcgatagtccttaaaagcaatcacattgccaaatactggaatatagaaaaatagaatgagccagatgactcctggcaataccattaggaaaaaaatggcattttgttttagattttttatgaggtctttcatcatagctcctttctattatgaacctttacattattagtttactcctgattgggccaactgtgaattgccacattataggcaaaattctacaaattataggtgtatataacaaccgatataccttctgtaaaaaacaaagaaaatctgggttgctaatcaaaatttgcataaaaaattgagccctttcgagctcgagaactactaggtcgtatagatggttgaagccgtcgcaataatctgccattggttggcagttgtcgcaataaatcccttgtcctgatggaagtcatcgtaagggagaattggcacttctagttcatctagtttaggtacttcattgttcagataggcttgcaaccgctggattgctcggcgaatgcgggcatccaatccccctaggcgaatgtccaccgtatccagaccaaacaccttcttctctaccatccattggtagctaagtgcctgatagaagctttccagatctattcttagttgctgcaaaccgtcaactttctctgccaagacctgacgatttccttcctgataggcctgacgaatacctactgaaatagccgccttggtcgctaaaacctgacacaacttagcctgagtatcaaagagataggcatagcccttggctcggcttccaatctctgccaatctaggcgctaattcctgataaaaggcattgtctttttcggcatcaatatgctcttgcagcaaggggcagagaatatcctgatacaaaatgtagcgactgggattgaaaccgtgatgacctggacctgggtgactaggtgtcttatttggcaaatccaattgcaggaagtcatctagggaaacttggtgtagttgatagaaatgctcagccagacagcccaaatttcctcggtactggagttctgcccaggcatgaagactcggcaagatcgaaaaggttgcgcattctccaccattatctccccaagcggtcaccgtcacttcttggacgccatactcttggcaggcagcatgtgcttttggtgcaatccgcatactgaaatcattatcaggagtaaaaccaatccacttccaggcaccacttgcaaaggcaatctgatctcccaactgctgatgactagctagtttttgaccatagctctcacgactagtctgatagtaatcccaataaatcaaggtcactctgtccttgagacgatccaaataagcctgaatttccgaatcaatttccaactgaccagtataatccttactcgctgtcaacaactggaagaacatatcgctccacatactacaatggaagccgtacttgtcagcaatatccaagacccgttccaagtgttggcacataatcagacttcgtttctgatagccgtgttgattgaggtattgacccagcccgaccaagtgagcctcatccataccgatgttaatggtccgtgttttcagatgggacaaagcctcaaacatcttatcaatcaaggcataggtcctctcatccccaatcaagagaatattatccacatctcgaatggcctgaatagatgaaatgttccatttgaggtaggcgatcagatgggccaaggtctggatacagggaataaattccataccgtaacggtggcactcctcctcaatagcctgcaattcttcttttgtataggcccctcggaaataaccaaaatagggttcatcacgtagttggtaggtatcttccatgtaaagctggaaatggctgtagcctatcaaggccaattgtctaatcaagattttactggcttcaaccgtcaggacagcatttcgagaacaatcttccataaaaccgagttgacgataggcaggtctttctagaatctgtatgtcggtctcaccctgagccaactgactagccaaaacaagcaagcctcgataaatcatgtgttctttaggcgcacggatacggtaagaacctgctgaaccttcaatccgcaaactctccttgccaccgacttcaagttctaactggcaatccaagccaagcgaggaacaaatctcttccaagaccccctccgactgccgtaacgaatggtttatctgtaacatcatcatttctccttattgtagggtcttcatataagcacccatgagattggcatcctgctggtagtggcaggcacgaatggcaggtagataaggaaattcttctggatattccttttgaatagcctctagttgctcctgaatagcttggataaagactggattctggctgatagagccacctatagccagcacttctggttccaggaaataggagatatttaaaatgccataggccagattgcgtgtcatttcttcaatggctaattgacatacctcatctccctgttctgctagctcaaaaatccgcttgccgttccaatcttccacagcttcctcatactgactagcaacctgtctgaccaaacttccagtagaagcaagttgggaccagttttttagaggtccctttccagtagcaatcagcatatagccaaattcgccaccgaaaccttgtttccctcggatgagttttctatccacaatcaaggcaccaccgatacccgtaccacagacgacacaggcaaaagtcgataactggtcatcaacagccaattcactcagaccgacacaattggcatcattttccaaataaacaggacagccatactgacttaatagctcataccaagatacaccatggatataaggaacggcactcagcccctggatgacacctgtttcaaggtctaccgctccaggtatactgagggaaatagcctccaagccgtctaccggctgaataacactgtccataagcgccaacaattccgctaaactagatggcgttttccattcctgcctatagtttatctgcttatctgaaccaatcagggccgcctttattcccgtaccaccaatgtcaaaacaggctactaccatgttctttctcctttccatgatgaccaacgacctctgttcggattgcctgtgacccaatcctagccggcaaatcctctagtggttcttctagcaaatcaaccccctcagtccactcgctccaacctgctaactgctcctgactcatattgtagtaacggagcagaatgcggtccgaagtctctgccaccttcaaagaagtcacgcataagcggtcctcttccagtgctggatggctcaaaaactgatgatcacacggcagatgcccactatggctagtcaactgtttagttagcaagtgtccttggaaggcctgcgctctttggaagctggcaaaaccttcctctactgggcaaatttcaaaggcatagtccaactgacattccctcaaacactgggcttctggtgttgggaagtagccccaatctcccagctctccagtcgcacgaagcaaggtaagagctatttttcccttgtctaggatttcatactcatgtaggcccttactcgaaacggtcatggcttgtcgaccatctgatagactaataaaactgcgatgacgctgaggattggacggattttcccaggctggatgtggctgatttggacgttcaacgacttcaaagatggaatccgccaagtggttctcagcttctattccaatatcaaagactgctcgcaagcgatggtccttgatttggttgtggaaatcggtctggatgcgaatttgggattggtggcggtagagtgtcagataggtggtaaggagcaggtctttcttttcctgactcctttgagatgttcgatgtttaaattctaccaggcgcttctgttcatcttccagacttgtttccatagctacaggcagctgcagacggtgcatgaccttggcaatgctgaccgcttctgtttggtagacaagaccgaagtactctatctgaccatagatcggttggtcattcttaggcgccatgaagatatattcattgcccaaatctccacaatcttcaaaccgtagccagtctttataggcttgacccgttctcttatcttctagcaagagctgaccatccatcacattgatacggtaataatcattctcgaactgttcacttaaactgctattcaccctagtgtcaccaatcggcttgacttgataggtctgccatgaaaatggtgcttgattttccactacaaagcggacacgaatctggcgggcaaaattggcagagcgaaaagcatcttttggtaaatcgtagcggaagttgacacctagatcttcaatggtagcttctacctcttggccttgactggtaaagaggcccaaggctggcagagaaatagctgccatggattgaaagtgttgttctaactgcccatctcggaaatcctcctgttcaacaagcaaatcaacctccactaactgggtttgtcggcaggctgtagtattgaaaaccgtaaatagtaagccgtctaattggctagaatccacctgcttttcccacctgtctagggagcgctggctcaagaaatgagcgacttgcttgaccttcttaaagcgggtttccatctcactatgcacctggtctacgctacaaccacagatgctatcatgaggggcattctgcaacaagagtttccaggcatagcgcaactcatctctgggcaccttatctcctgtcattaccaccaagggttctacaacttgttccaagagctgactggcttggtcattggcctgcttgagataaattctcgaagaagccgtatttgccaaggtgtaccagccatccgtttcctggctaatcaattctcccttgacacgactgaggtctactggtaactcttccttgacagctgcgatatattcttcaaagcttgaatgaacaaagtctatatctggatacagttttcgggccagtcgtaatgcttggctgagatttttctggacaggctggtggtcacagccattcatcagcagatagtgggaggttgaagcgtatttgcgaacatctgccaattttttctcccagaaaacacgtgcttcctcctcatcaactgggatttcattgccattgctgtaccagttagcaaataaaatgcccagaacctgactgccatctgccccctcccaaatcatctccgagaaagtggactggaattggtcatctcccagaacctgattatcaaagccaactggtttgaccccacgaccaaacaaggccacatctataccagcctgacgcagtagctgaggagcctgtcccatattgccgaaagtatctggataataaccaatcttcggagcccgtccccacttcttgctttccaaatgacccagaagggtatttcgcatattggcctcgctggtgatgaggtaatcatcctgcaagatgtaaaagggaccaataatcagccgaccgtcttgaatatatttcttcaataactctcgattctgcggacgaatttccagatagtcatctaggacaatggtctgtccatctagatgaaaactcctaaactcaggatctgtttcaaataagtcaaacaggtcatcaaatagctctactaagcgcatccgatgttcttccaaaggaagataccactccctatcccagtggctatgtgaaataatatgaaccgtttcttttcccattttattcctccggtcgtatatcataataatctaaaaccaattcgcaaaacatcatatttgcccaggagaaccactctctagagtaaagcgtcggatcatccacatggaaactctcgtgcatcagcccagtaccgccatcacaggctaccatggtatccagcaagcgcgctttttcttccttgtcatccgttgtcaatccttgaatagccaaggcaatcggccagatatagcgatagaaggtatgactggaaccaagacccgcagcatagtctccctcgtagtaatagggattttcttgacttaaaatagtccgacgggttgccaaatagatgggatcatctttctgacagtatcctagatagggagccgccagcaaactcgggacatttgggtcatccatgatagactgattgcccaatccgtccacttcataggcaaaaatagtttctcccgcctgattcttggtcagcccgaaggtccgaatcccctggtcaatttcctgcgccaaccgtctggcaccttcagccaaatctgagaattcctcacttgcaaactgctctgctatttctcctaaataacccaagacgacgaccgcaaacatgttggaggggatgaggtaagggtagatacaggcgtcatcgcttggacgaaaaccagaccaagtcatccctgtataggcgcagggagccccttttccttggtgcgtgagggtatcctctagccggtctgtatcccgttcaaaactataaggggagttttcatggtgctgctccaatttccagagttgaacaattttttcagctgccccaaagaaggtctggttaaaatgactggtttcccctgtcgctttccaaagtagataggctaattgaaggggatagcagagggaatccacctcatattttcgctcccaaatccaggggcctatctgagtgtggtcggtctggtgcccccgcccattagctgcctgattaaaggcattggcataaggatccatcaaaataaaggccatttgcctctctaccagacctacaatcatctggcgtaatttctcatcttttctagccaaagctaaatagggtttgacctgggctgtcgagtcccttaaccacatggctggaatatcccccgttaagacaaaagtagtcccatcttccagctgactaatggtcctatcaagcgtatccgtataacacctttcaaatacactcccccaacttgggtggtctgctgttttcttctgaatgcctgtcagccagttctctatgatttcttttgtgtaaaacatgatttctcctttttatcctttgctcagagttcttccaacctctatctggcaaatccatataattttcattagacacaaggttcctagtatcagtctatacaattctatatgcaaatcctatacacaaattaaacgcatttttacacaaatattgccagtttcggaaaacgctttcctttctttcccattctctatataataaggagaacaccacttattatcaataaaaaaagaaaaggatagcctatgtatacctccattgtttcaaccattgacacccgctatggtacttataactcacatgccttttcaaacggaaacaccctgccattgataggggtccctttcggcatgaattattttgctccccagaccagcgaccagactggaaactggtggttcaatccctatgaacctgtctatcagggcattcgcttaacccatcaacccagtccttggttgggagattttgcctccctcctattgacgcctgtcacaggcgaattaagccgagatagcctctttcaccgtcaatctagctaccaactggatcaggctattttccgacctgatctccttcaattacaatccaatcgctatcgcttgataagccgtttagctcccagccgatacggagccagttttgagatagcgtcttttgctaaccagcctatcggaatggtcttctattcatctggaaaatccatttatcgactgctcaatcctcaccaattgctcattcagatttttcaggtcagcgcctgccaatcccctgatttctgcatgtatgctctcctagaatttgaagaggaaataacagaatgttatcatctggtcaaggatcgcaagatagctaaaacggaagtggtgggagaagatttgcaccttcgcatcaacttctcaagcacttctatcaaggggcgtttggctacctcttttatcagccctgagcaagccgcctttctattaaaagatgttcctgacttccttcaagcccaaaaacaagcagaaaacacctggaatcagctcttaggacgtattcagattcgtgacaaaaaaacagaggacattaacttcttctaccactgcctctaccgttgcctcctctatccacaaactttctacgaacctaatcctgacggacaagccattcatttcgaccctatcagcaatcaggccaagctaggtaagtttttcaccaacaacggctactgggataccttccgctcttcttatcccctgctttcacttatctacccagattatttggaagagtttctccacggcattctccaacactatcgagatactggatttttacccaaatggctatcgccagacgagcgcggtatcatgccaggaactcttgtggatggagtcattgctgatgcggcctgcaagggacttgttcctgatttgatggaagattttctccaagccatgattgaaaccagtcaaaagaccgatgcggatcaacgttacggccgccatggtagtcagatttaccgccaattaggctatctccctctcgatttcaacgaatctgtgagccattctcttgattatgcctacagtgattgggctatcagccaagtagcagaaaaactgaggcaggaccaactggctaagcaatacgctcaaatgtgcctcggctaccgacagttattcgatagccaaacaggtctcatgcgtgccaaggatagacagaaacaattccgagcagatttttcccctctaagttggggaagagactatgccgaatgttctgccctacaggcaaccctgtccgtctttcatgacatcgatggactgatagaattgatgggcggaaaagaagccttcaccaactatctaatccagctctgtaatcaggagccctatttctcacctgaacaatacggctacgaaatccacgaaatgtcggaaatggcgcaagtcaatctcggtcagcttgctatttcaaatcaaccgagcttccatatcccttatcttttccaatggtctacaaaaccggaatacactagtctactcattcacaaaatcagacaaacagctttcaagacaggttttcaagcctatccaggtgacgaggataacggtagcctttcagcctggtatattttctcctgtctaggcttctatcctgtctgtcccggaaaagctgactaccaaatcggactaccgcattttaaggaagtagacttgctacttgcagatcaacacaagctgaccatttctactccaaaaagcgatgcaaatttccagtttgtcaagcaagtttcattagacaaacaagtcgtccaaaccatcaaacatgaccaactgataaaatcaaactgcctagaatttgacctatctatattaccaagtaactaaccagcttctacaaacaaaagaaatagtcaggaccaagcctgactatttcttttattcaccttgctttctaagcttagctaactgagataggccagccaaagccacaccaattaacccaagaaagacatacttctcctgataggtatcaccagtttgtggaagaccactcttctgcagagaagcatctctgatctgcttttcaacctgcaggctattttccaccattaaagtcttctcttgctggataggcaaaccgctgccgacctccactattttcggctgactctcatcagcaactattcgtgaatacagctcgcgacggccatcactatagactaggtgagctatcatcatttgaccatcagccccctcctgaacaattcgctctttgcccagtggcaaatcagtgctggtctgtgtgatgatttgtctcggcaccagctcataggtcaaatccattctcggtttttcaggagctagtaaattcttagactccatcgaatctcttgtaccgacatgagttaccagactagactgttcaaacaaatcagtccattcactgagcagctccttcatctcatctggacgaatactatccgaacccaaaattttctcagttttttcaagtaaagaacttagctcagaagaatttataggtctatctattcctttcacctcttggattagctgattgagacgcccaagatctgcttggtaaagtttctccccatccagctctcctaactgtttctctaaaagagtttgagcggcttcaacctgctcgactgtccgattggtatctgctaccacagacttagcttcttccaaggctgtttgcaaggcaagttgtgtctgctcactagaatagagataggctgtttgggtttgtagagcctcaatttctgctattttctgctttagatactcatcattgacgattggcttcggtgaaacaaggacatcaaatgaagtctccaaaccagcataccgcaaacctaggctctgacgcccctctttacgggaatcgaaaccaacaatttctactccagcttctgtcaaagagaaggactgagttgactcatcgtcatagataatagcaaatcgaccatttgtgacatccaaatcatctcctacaacatactgcacttttggtaactgttggatttctagaccgactgcttttttctcaccctgggctatatcttcaacaacatataccatcagtggctgagcaagtgtttctcctagataggaaacggtcaatgtttgttcacctaatttttgcggatcaaatccccttactgtaactgccggattggtggtattcacccgttcagcaggccaatctccttcaaaaactacacggaattgtgctcctgcaagcgataaaggactaccttgtcggtaaacttttttctctaggggagctatccattccatcgctttcacgactttttcaccttgcggaacgcgaatggccaatagattgctccaatcctttccttcctccagagtacggtagtaaatgaactcaggcagggactcaaagcgaatcgggtcgaatataagatttcctgactctgtcgtttccaattctgctagtggttttacggcatctggactagaataaagcgctattttccgattggcagggacatccttgaaacctacttgaatctgatgattaccgagatggcgagcaacagcatgggtcatcggaatatttggtgtctccatgtccaattcttcatacatacgccaattataaatacgaatggccttccaaggagtaccattatcagaagtcaagacatccaaacgccattcctgcgctcgaattggcttgtccaatacgatgtctgtcacatgatcacgattgccacgaacttctttggctaacacccaatcaccattctcatttttataatagagatcgaaatccttggtgttcattaagccatcattgaccgattcaccacctgcaccagcatgatccatagcccatcgcacgactgtccgaggttgggtcaaacgaatatctacatggccactcaattgatgggaagaccatttatctgacaaactggtaatggtcccattcaacatgccctcaatgccttctccaccttcttttttagcaaaacttgaaccgatgacttctgctccgagaacaatgttttctgccgatggtttaggaaggctagtatctttcaccgtcatctcccaatcaaagataaactcccctgcttccgaacgcaaaccatttttcccaacggcatgaactttcaaagcttgggttcgaccttctgcctgtgcagaacgaactagttgagggaggtaaatccttgtattagaagaacctgtcagcaatttccactgtccgtcaacctgcgcatatacttcataatagtctgcatcatctgtccctgtaaagctaatcacagcttcagcatcttgggcattcttcaatcgcttagcaaggacttggccatctttcggtgcagtaggtgaattttcttggtcataaatagccaactgccctaaacgaaaatcaaaatctgacagcgctgcttcattttcaacaaccacttggataccgtacactgtctttcctgccaaactagataaatcaaaggtctgatcttgccaatctcctgatagtttaagcaagcgccacgcttctttattcgcaaattgataatctggttcaagcgctagagctagggagatatttgcaccttgccctcctttgtgcgcaacccgtaaacgacttgtttctgatagaggaatcttggtggaatacaacttaatttcctgcttaccatctttttccaaatcgcctgtaaaacgaagagagttgcccccattataggcatcatcaaaatcataagccgcagcaagcttttcaccacttgcttcaatccaccaccgccaggttggtaaaataccagacacagaacgataattccattccccatctttggcaaccttgccatctacaaaccattttttcccgtgccctgtattaaaggaactattgaaattactgcttgtaatagccgtcttatccgcaatgagattggccaagccataccaatttttatccgaaggtttctgtttggttggatcaccttgatagcctgtaaagaagatattctcattctcatgataatcctcacccgtcgcacccaaacttgtaatggtatctggcgcaaacagaccgagtgataatttcaatttcccgttttcatcaaacagagcatcccagttaatttgcgttttgtaagagcctccccgttgcaattcaaatccagcaaaaatatcaaatggatttcgaccgattcgtttcgccacttcgattgaatagttatttttggcccgtgtccagttaaaattcgcaaagaaatgatccgcagggaccttgtctccttccttttccataaacggatagttgtactcacccaaaccatcttcgtgatagcgaccatattcgtaggtcatggcatcataccaagaatacgttatcggataaccaatcgattctgcatattccttggtatagagcatgaagtttctcattgtttcccctagtggttgaaccaagcctcctgtagtctcttgatttatgaaataaccatcgaaaccgtagtatttagccatatctaccaacttacgagcaacaggaaaacttccatcaggatcctgtctcatagaagatacaaacttctcttgatcttcaatactactggaccaattgtagaaaatcgttcccaaaacaggcacaccattacggtgtccagcatcaatgacgtctgggctaggaatcaagccttcccaaaataccattgaatcaatatactgccagtaatcaaaggcataggctttaaactcttctcccccaacagaggcatggtctttcgccttagagttggtatttgaaagagcttctacctttgcattctcattggctctctcattgacgacgtgccctctaaagcgctcaaccaactctacagaagcgcggttcaaatcatcatctggacgagcacccggctcccaagcaagcacctgatcccagttgtcaaacttaatctctttcggacgaattccttgatcctctacctgaggaaaatctgaaagcaacagaccagaatctgaagaatctacctctttatcttccgcttcctctgtatcctctagtttattttctggattatcagacggagctgaaggcagtttttcttctctactatctgatacagatgcttctccattcaactcttcggtcaccgctttctcgtctgctgaaattggtgacattccttcttcagcttcggtcttttccacatgttcgttcactacggaagagagttcaacagctggctctgacaagctgtccacattttctagctggtccgcagaaacctgtgttccaaataaggtcgcaccaatcaaaacagaacaagcacctattgtaaattttcgaataccgaatcgctgacgtttgtcgaaatcacattttgtcatattttcctcctacacaattgtagtgcaacagctgttctcaatttcctcctttccagatcatagttggcacatgctacctttgatagaacagctatcacacgaagtttatcaggttttattaattccattgtacagaggaaaaatatgaccttcaagccctcatggttcccttctttaaatcagataaaaagaactttagtttagagaaaacaaaaaagaggaagtttccctcctcgttgtcttcgttaattattttctacaaacttaatacaccaacctaccagttcatccaggcgttccatctgctctgtcatgtgcaggtagcccaagaccgcctcaaagcctgtggacatccgataggtgaccacgtccgcattcttggccttggtatggctattggtattgcgcccccgcttgtagatttcttcctctttttcggtcaatagctgagcttctaagagggcagaaatcaagcctgcctgagccttggccgagacgtatttgttagcctcgccatgcaatttgttaggcttggtcagtcccttgaaaatcaagtgccgtctgatatacatggaatagacagcatccccttcaaaagccagagcaattccattgatgagattgacatctactgccttagtcacgtgtccacctcacaccatccttggtatccaagagcttgatgccctgagctgccaattcatcacgaatacggtcagccgtcgcaaagtcccgattggcacgcgctgcttgacgttctgctatcaaggcttcaatctcgctgtccaagacttcttcttcaaaaacaataccaaagacggcgagcatcttgccaaaggcttcttttacagtttcatcgtagttgcctgagttgatccatttggcaaagtcaaagatagccgtaatcccgtttgctgcgttgaaatcatcatccatggctgcttcaaaggccgccagatgtaattcaagagctgacttatccacagagttttgcacaggttgtgtataagtattttttagatatttgagattgatttccgcatctgaaatagccttctcagtgtagttgagtggacggcggtagtgctgggtggctaggaagaagcgcaagacctgaccatcaatttgttccaacatatcatgggctgtcaggaaattgcccaaggacttggacatcttctcatcattgatgttgagcatggcattgtgcatccagtagttggcaaaggtttgacctgttttgcactcagactgggcgatttcattggtatggtgaggaaattccaagtccgcaccaccaccgtgaatatcgatggtagctcccaaaatctctgtcgccatgaccgaacactcgatatgccaacctggacgacccgctccccaaggacttccccaagaaacttcgcctgacttggcagttttccacagggcaaaatcgaaaggatgttctttcaattgaccttctccctcaacacgaccagaagccccaacctccaagtcagatagggttttgttggccaaacgagcataattctccaccttttccacacgaaaataaacatcgccagccgcttcataggcgtaacccttgtcaatcaagacctgcacaaaatcgatgatttcatccatgtagtcgataacgcgaggatttttggtagctggcttgacacccagttttgtcacatcttccttgaaagctgcgataaatttatcagacagttccttggttgtcatgcctgcttcattagcagctttgataatcttgtcatccacatccgtaaagtttgagatgtaggtcacatcatagccacggtattcaaaatagcggcggatggtatcaaaagccacgacactacgggcattaccgatatggatatagttgtaaaccgtcggaccgcaaacatacatcttgaccttaccctcttccaagggcacaaagtcacgcagactgcgagtcatggtatcgtaaattttaatcatagtttctccattacttctgagtattctttaggacttgatacttttgatacaattttactagccaataagctgtcgcggccaaccaaatcatccctacctgccagcttccttgggagaatttaaggataaacatgattgtcccagcgatggcggtcaacacataaggccagttttgtcttactaatttttttaacatgatctactttctaattttcttgcaatggccatggccacttcaaagaaggtcatactgtcagccatccgttcctctcgacgggcatcccattcattcttgtggtggtccacatagtctgccgtgtagaaaaattggtagaccttggcctgacgaaagtttgcccaggccatgatagcagaagcttccatatcgaccaccatggcaccagcggctaggcgacgcttgaccttggcagctgtttcccgaaagaaagcgtccgtggtccaggtcttagcccgcacgtgctcgattcccgcttggtccaaggccttttccatggttaatagcagagcagggtcatagctgatttcctcgctagcaggtgcgtagtggtaaccagttccctcgtcccgaagagcagagctaggaaggatgatcttatccgcagcgagcgacttatccagcaccccacaagaacccagaacgataaaattctcaaagccacaggctttcagctcttccagatgaccaactgccattggagcaccgattactgccaacatgaccgcaacctgcagtccatctctttccaaaatataccaaggatggcgaccatttaacgtctgaagatgaccaccttccctgctttcagctagctgacttactcggtccacgatttctccattgaaggagaaaatcatcgtctcacatacctctccaccaccacggatagccttgtccgttggttcaataactgcagaggtgttttcaaattcttctagtagcatatcagccttctttcctacaaatgcgacgaacgatggctggcttctctcaactctgctaattttgtcgtgtagtgttcacgaccatcttccatgtcatgaatgatcttctcatctttttgaccatgaacacggacgattttagccggcataccgaccactgtcacatctgctggaacatcggctaggacaacagcagcagcacctactttcgcattttctccgatttcaactgggccaatcacctgggcatgagcagaaacgagtgccccttttcgaactgttggatggcgcttccctgtatccttgcctgttcctccaagagttactccatggtataacattacaccagattcgacaattgcagtctcaccaattaccaatcccgcgccatgatcaataaagactcccgaggcaatttctgcacctggatgaatttcaatgttggtccaaaaacgccaaaactgactgtgcatccgagctaataatttaaaaccattttgccacatccagtgagagagacgatgagcagccagtgccttgactcctgggtaggtcaaaaggacttccaaggagttccgtgctgccggatctttttcttttacaatttctatggtatccttccaccaacccatgacttctccttctagcgagaagacaagtccatttcgggacttgcctacttcaccattattttttatctactttatgaaatttaaattcaccaaagttattatcttttttctctttgtgttctttatgacgacgaggtttttctgaacgttcacgtttttctggttccacgtagccttctggttttggtagaagagctttcatagaagcatcaatacgtcccttatcatcaatttttatcaccttaacatctacaacatcgccaacctcaaccaaatcttctggtttattgacacgtgtccaagccatttcagaaacgtggacgagggcatcggtcttgtcaaaaaggttgacaaaggcaccgaatttctccaaacgaaccacttttgcttggaagacttcgtccacttttgcttcacggacaagaccagcgatgatttcttttgtgcgctcaattgcagcacggtctggtgagaagatcgccacaagaccgtcttcgtcgatatcaattttcacgccagtttctgcaataatcttatcaatggtttcaccacccttacctatgacaatcttgatcttgtccacatcaatcttgatagtgtcaatcttcggtgcagttggtgccaagtcaggacgaacttctgggatagtcgcttcgatgacatcaaggatttcaaaacgtgccttcttagcttgtgccaaggcttcttccaagatttgtggtgtgataccgtcaattttaatatccatttgaagggctgtgataccgtcacgagtaccagctaccttgaagtccatgtcgccgaagtgatcctcaagaccttgaatatcggtcaagacggtgtaattggtaccatctgagatcagacccatagcaatccctgcaacgggtgccttgattggcacaccacctgccataagggcaagggtcccagctgtgatagatgcctgtgaagaagaaccgtttgactccaagacttctgctaccaagcggatagcgtaagggaagtcttccaagctaggcaagacttgctcaagagcgcgctcaccgagagcaccgtgaccaatctcacgacgacctggtgcaccgtaacgaccagttgagccaactgagtattgcgggaaattgtagtgatgcaagaagcgtttcttgtactcatcatccaaaccgtcgatgatttgggtttctcccattggtgccaaggtcaagacagagagggcttgcgtttgaccacgggtaaagagacctgagccgtgaacatttggcaagaagtctacttctgcatccaaaggacgaatctcatcaacacggcgaccatctggacggaccttgtcttcagtaatcaaacgacgaacttctgtatgctccatgagttccaagatttcatggacatcacgcatgatacggtcaaattcttcgtgctcagcgtatttttcttcgtaagttgcaatgacagtctcgcgaacggcattggtcgcatcttcacgggccaatttttcttcaacctgcaccgcttttttcaaatcgtcattgtaagctgcaacaatctcagcctgcaattctgggtccacttgaagaagctccacatctgctttttccttaccaactgctgccacgatttgattttggaaatccaagagttcttgaatggccgcatgacctttcaagagtgcttccaacatcacttcttctgataattctttggcacccgattcaaccatgttgatagcgtctttgttaccagcaactgtcaattctaaaagggaggcttcttgttgagcttgatctgggttaataatcaattcgccattaacataaccaacctgaacaccagcaattggaccattgaatggaatgtctgagatcgctaatgccaatgaggaaccaaacatggctgccattggagcagatgcatctggatcataagaaagcactgtgttgatgacttgaacttcgttacggaaaccttccgcaaacattggacgaatcggacgatcaatcaaacgagctgtcaaggtcgcatcagttgacggacgaccttcacgcttcatccagccacctgggaatttcccagcagcgtacattttctcttcatagttgacttggagggggaagaagtctcccgtcgccattttttttgacataactgccgctgtaagaactgtggaatcaccgtagcgaacgacaaccgcaccgttggcttgtttggcaacttgacctgtttcaacgaccaattttttgccagcaaaaaccgtttcaaatacttgttttgacattaattgtctcctattttttctgaaatttttcttgcgtgttttctacaaaagacaatcaaacaagcttgtttcactctcttttgcacaaaaccacgcatactccttattttatcatattttaggtagaaataaaggcctgaaactatttttgacaagaaaacatactcatgataaactattcaaaatagttggaggtagaaaatggaaacttgccatcttgtagttcctagtttaaaatggaagaaccaaatcctagcctataaagaagcatttagcaatgaacatcttcatggtggtggcaaactgcaacaatttgaagcagttgaggaatggctagaacacattaaagctgtgtcatcttatgggacaaatcatacagaacgttctccttcttctacatttctttgtattcgtgaaaaagatcaacagatggttggcatttgcactattcgccacgatcttaatcacgagcatttaaagaattatattggtcatatcggctattctattcacccagaagagcgaagaaaaggctatgcgactgaacaactacgaattgccctgctggaagctaaaaaattgggaattgcccaagtcttaatcaccgctgcagattggaatattgcctctcaaaagaccatccttgcaaatggtggagtttatgaggatacccgtattgaccctaatagtagcgagcgtatgctccgatattggattgaaaatttgtaatataaaaacctccaatgatactaaatcgtttggaggcttttttaagttaccgattattgaactctcagaccaaatactcgttttatataaaggtaaaatgaaatggatgtttcacaaaatctaacaaagggacatcgctttcatggacatggccaacaaccatttggcggtcgtcctgaggcaagtcgaccaaacaaatttctagttctgattgataacgaagaaactgttcattagcaagaacaatatctcctcgttttcgatgacttgctggcccttgaattgcatatccttttaactgagcccttgaatggctagcacgtatgacatattcactgcatcaattctattttcgaaattcattcccttcaattgctttggaaactgcgctgataaggctattataccctttgtcaaatatgaaaatctttctaatgaagcactcgataaggcattatccccaatacaaacataatcactttcacaacacatcaaacaatcgagtgcggcttgaattggaggcaacgctctatgttcttcaacggttggaagtccttcaaaaagcggaaaacgcttgttatctccaggaataaaggtgatgacttttattccacaagagtgtagccgactatttaggtcacggacactacttccccctaaacctgtataaggcttaggataataattatgacatgccaaaacttttgttttctcaataccaacgtccatcatcttccttaaaaaatcatctgacaatgtagatgcatttaagacaagtaaaaagtcttccgacaatgatttcatgacttcaatagtaattccatcatcaatcctaagtgctttaataccgagctttttaatcccttcattcccatatcgcttcaaactatcttgattgatatccacaatcaaggtcagcccttctcgttgacattttgttacaatatgacgaatcttttcgtctcccttctcttcttcatttatattaagcgaagagaaaacaaaggaaaatcctgcattttgatattctataaaccacttttccgaattagcaaatgagttagataaatagagtgaaaaaccgaaacgactgaaaaaatcattaacttccatatacggtctcaattctatcttcatccacaccaaagaaccaagttagtacaaaaccacctacatatgcagccagcatcgctataacaaattgcagttggcttccaggtaccatgattaacagtccaaacaaaccagaaactccttgagatacagtccctaaatggaataacactgccaaaataccgccaaaacctgaacctaaacaagcggttaggaaaggtttgcccaatggcaaagtgacggcgtacatcatcggttcaccaattcccaagattccgactggaatagaatctcgtgttagttgtttcaactttttattttttgttttcaaaaagagtgctaaaccagccccgacttgtccaccacctgccatcatcaaaataggcaagagataatttataccacctgttggcccagatggatcattcaacaaaacatgtattggagtcaatgcttggtgtagtccaactgataccaatggtaagaagcctgctgacaaaatatacccacctactatacctagcttctcatatacaaaatttaatccactataaatagctgtggttaacacttctccaagaggctgaatgactaacaaagcaaccagaccacccaatattactgtacaaagaggagtcaaaaaagtgtctaaaaaacttggcatatattttcggatatttctttctagaaatgcaaagaaaatcccaacaaatagagccgctaacaaaccgcctgcactaggtgagaatgccttgtccacaaaaggtaataaaattgatttgtcatccactactgtcaacaaaggcattgaaggaactgccacagacatagctccggccattgctcccaaaatcggacttcctttaaattctttcgccgcattcattccaacatagattggcaaaaaagtaaagagtccccaactcatagtcctaatacattgataccaccattccattgcaaaagcattcccggttgatacattaatgacatttgtaatcccatttatcaaacctgccgcaattataccaggtaatataggtataaaaatattagcaattttttgcaagaatcgttgaactggcttgtcgtacttctctttatttatccttttatttgtagcagcaacatccgctgttgtgtaatcttcttcaacacttcccaatgatatacctgtcagttctgaaaatgcttggccaacctttgtcactgttccaggcccaaaaacaatttgaagtgtatctgcctcaacaactcccaaaaccccttctatgtttttgagactatcaaggtgaaccagcttgtcatctcgtaactgtaaacgaagtcgtgtcatacaaactgcattccctaggatattttccctgccaccaacattttcaagaacttgctttgcaacatctttcgtatttttcattttaattctccttatccaaaattgattgaattgcaaatgaaatgtgattatgatagttttccagaagtttttttgcctctatttgatcaagttgactcaactgcatcaagatggctaatttcacgtcttggttggcttgttgaaaaatatgttccgcctccatctctgtacagccagttgtttcacaaataattctttttgctcgttgaatcagtttttgattggtcggttgcacatctaccatgaatcctcgaaaaacttttcctagttgtatcatcgaggtggtagaaatcatattcagaatcattttttgagctgtcccagctttcattcgactagatcccgttacaacctctggtccaaccaatacttcaatcggagcatctaccaatggggagatttccgcatcttgtacacaggaaatactggccgtctttgctccaatttcacgagcatatgtgactgcctcaaggacatatggagtcctgcctgaagcagcaagcccgataaccacatccttcgccgatataccaatttgttgcagatcctctacagctgctgctcggttatcctctgccccctctttggcggcacgtacagctccatttcctccagcaataagtccttgtactaactctggagaaactccaaaagtcggcggacactccgaagcatccaaaactcctagccttcctgaggttcccgctccgacatagatcagtctaccatcctttttcaagcagtcaacgactatttctattactgcattaatttggggcagtatacgttgtacagctaaagcaaccaggccatcttcacgattaatgtaggcggtgatttccccgatagacattgtctcaatagcaaatgagtctggattggactgctctgtattcaatcgttcaatatccatcttattctcctttctttttttgtaaacgtttgctataatcgtattatacaacttttgtattattatttcaatattttttagaaattaaagaaactttataacagactgtgttagaagggaatcattatgaatagaaacattttaaatcactcgatagagaatttaacccctaccgaaaacaaattattggattatattgaagagaacatccatcgtattgaaacaatgaatatctatcaattagccgataacgccggagtatcaacagctacaatcagtcgaatcagtaaaaaaatgggctattctaactttaataagttaaagatagaaatagccaaatcgaaatatgatgatttactcaatgctcacttcacgccatcagattcgattgacgatatttctactaaattaattcattcaataacaatttcaaatcaacaaaccgtcagttttctaaacttggaagaattagaagccgccgtaaaattattacaaagcgcttctcgaatttatttatttggagttggggcatcaggtattgtttgcagtgacttttactacaagctgagtagaataggtaaaacatgtatttttgcacaagatacacatattcagatggctaatattgcaaccgctggaaacggtgacttagcaatcggaattagttatagcggaatgacaaaagaagtcgttgagccacttcgtttcgcaaaagaaaatggagtttcaacgataactatcactggaactggtaagaatcaattagcagatttagccgatattacatttagaatcccacgacatgagcatgaacttcgagtcggggctattacatcacgaagcaactcacttttcctaaccgacttgctttacctagcacttatccaggatcataaacaagagattacagctatcttagaacaaacaaaacatcttacagaagtaatcaaatagaccacctgataaatccactacaaaaagcaaatcccctaagctcgatcgaatcttttattgaagcaactcatacaatagggaaaaaaacaaaaaacacagctcagtatacaagatactggtgctgtgtttttttgtttctatacctgctaattaacgacggagtccgagtgagtgaatcaattcacggtaacggttaacgtctgtgcggcgtaggtatgccaacaagttacgacggcgaccgatttttttcatcaaaccacggtaagttgcgtggtcttttttgtgttgtttgatgtggtcgttaaggtggttgatttcccaagtaagtactgctacttgaacttcaactgaacctgtgtcgccttcatgacgagcatattgtgccatgatttcattttttttctcttttgagattgccatgatatgttctcctttgtttttgagcctaatccgagtgacaggttggcgacctgtaaccaagaaaaagctagatttgtccttttggacctcatttattctatcaaggattgtcttttttgtcaactgatttgaaaactagctgagtagctctgctattttcaaaaaaagccagcttttgctgactttctgcttgtatatcacatttactctgccttttctgcttttggcaagatgagattgaggataatacctacaatggctgagagggctgtacctgaaagggtgatggcaccgatgttgagaactgctccaccaagacccaataccagcattgagcttgcaataatcaggttacggacttgaccgaaatcaacacggctctcaatcaaaactttcaaaccgtttgaggcgataaccccgtaaagcaagatagacatgcctccaagtacggcacttggaatagtagagataagggatgtaaatttacccaagaatgagaaggcaatggcaatcaaggctgcattacggataacggatactgatgcgatgcgagtcataccgataacccctgtattttcaccataagtcgtgttagcaggtccaccgataaaggcagatacggcagtcgccacaccgtcaccaatcaaggtacggctgaggcctggatctttcaagaactggcggccgcagatttggctgagaacggtgtggtcaccgatatgctcagctactgttacaacagcaattggtaagatagcaatcatttctggaccgaagtagaaattgtacgacttgaaggcacctgtttcaaatggtaggtagaaacctggtaattcaaaccaagctgcttccagaacaggtgtgaagtcaaccaaaccaagacagagtgcaatcacgtaaccaccgatgatggcaatcaagaagggaacaatcttggcgaagcctttccctttggtattgacaaaagcagcaatcaagaaggttgcgatcgccacaacgacgtttttccagtcaccgtctgcgacaaagcctgccgaagtcacggcagagttggcaagacccagaccgataacgataatcataggaccgataacaatcggtggcaagagggtatcaatccacttggtcccgataactttgacaagcgcagcaatcaagacgtaaatcaaaccgacaaagagaatacctgtctgcgcagctgacacatcgccgcccatttccttaatggcgagggccatagctgagatgtaggcgaaggaagatcccaggtaaaccggcaccttaaactgtgtcgctacttggtaaatcaaggttccgacacctgatgcgaagagagccacggaaactggcataccgagaatcagtggcaccaagattgtcgctccgaacatagcgaacacgtgctggaaactcaacaaaatcccttgaagcggtgctggtttctcatggacatcaaacaaaagattggcttttgtactcataaatctcccattctgggtacacaaaaagacccagactttctaaatatacatagtcataggcccttaatgaattatcctgttgtctttctcacctcacgggatgagtttaaaaacctacgcttttgatattgtaacataagcccttacttttggcaaggaattttgtaaatttttattttttagaaaaatggctgagcaggagctgaactgcttattattactccatttttccaactctttttccacacgagctaactttaaacgaatatttttcatgccatagccatcctcctgtgcatttttataattttattacacactatattttctattttgaaatatatatcttacatttcgtttaattttttaacagaaaaagaagacaatattgccttcgtaatatacgtacatatttaggtattactctccctactccacactcttaatccgtttcttaatcttctggctaaactcaatcatcctccccttttcctccggccagattttggtcacgcggtcaacagcaattatgaagatgattaccgcagcatagtccttggctttttcaatcagaccaacactttcagcaactactaaaagtagatagaatgtgaataaaatagttcgtttgggtaacgccatcaaaaactcaatccctgccttatagcccagataaatctgccgattaagccctttggccttttccaaacgacgattgagaaaggcacgaatccgcttgtaaaaccaatccgaagttagaaaaagtgattgggcaccaattacaatcaaagaaacattattggcatgttcttccttaagccctagcgctctagtcacaacataggtccaatcaccattatcaatacagataaaaatagtaaagtaaacaaccgctcccgctactataacaaggggaagggcacggatatatttcaacatataataacctctcttggacaattcttagaacctatattcataaacaaagtgttcttatgcaagatatcgtttttgctcatcaaggcaattttttgaaggaatacttgactctatcaccatttagtttcactttattgcttcgacgagtaaaaagctcctgtggctgttttcgcctaccacctaattggtcaggaatctcctttccttatctccaccttcaaacactccaatggaagctatgaactgtgaacacaggttcttgtatatattgtaatatgttatgccaagtacggtcaagtaggggctagaatttcaggtacgacaactgtacacccttagcattttttacttaccccaaaaagaagaagacctccaatcgggagcaagtctcttctatttatctataattccacaccaaagacttctaattgctttaattcggcagcagtcaacctgcggtattctccaagcgctaattttggatctaagcgaagaggccccatggtcaatcgttgcaagtctgtcaccgtctttccacaagcctgcaccatgcgtttgatctggtgaaatttcccttctcggatggtgatgtcaacgagcgaggtctgcttagcttcatctgtagagaggatggtcaactgggctggttgacaggtaaagtctttcagctcaattcctgccgcaaatcgttcgacatcctcttgggtcatgatcccgtcaacctgtgctcggtagagtttatcaacatgctttttcggagaaagcatggcatgagccagctgacccttgttggtcaaaagcaagagaccgtgggtatcgatgtccaagcgtccaacaggaaaaacttccttctggcgagctgtattatctagcaggtccaagacagtccgatggtggtcatcctcggtggctgaaataactcccttaggcttgtttaacagatagtaaacaaaggtttcatgactaaggacctgacctgctactgcaatctggtcttttttttcgttaatttgctgtttgggtgatgtttctacttggccgttgactgtgacttgcttgtttttcaggagtttcttgacttctgtccgactgccaacaccgcaatccactaaaaatttatctaatcgcatacgagtttcttttccattttgatatattctgcttgcttttctatttctgtaaaaccaagagcatgaaagagtttttgggcaacttgatgagagctagcaactgtcagtttgatactagctggctgaacatgctctactaaatagtcttcaatagcctggtagaaagctctgccatttccctgacctgtcaaagaaggtttcatgcccaaacgaatgtcaactgtctcgccatcttggtcaatacagaaatagcccatgagggcagcattgcggatgactgcaaaaaagcggtccccacgcgcctctggtgaaatcatcacagcataaatctcggggtttgcactaatcgtataggcatccaaaggtggttgatagcgccattggttagcaatttccaatgccagatcctggggcaggggcatgatgtaaaaataatccattcttcagaaattttttgctaaatttttaatccgacggttttgggtggcgtaactatctgtctgataaacataatccacatagcccaactgataggagggaatcatgtccttaaaaatcaactgaacatcctctggaaaacggagtattaattcatttaagcggttattttctaacataagaatattataccaaaagaggctgggcaaaaagcccaacggctactacttagagttcgtgtcaacatctcagcgcagtggttgattggcagatttgttcgtgtattacactccaaatctgacctatacgactgatgcgaacagagttcgcttcatctccaacctcaaactgtctcccagacagtttgagctgtgcgggggtgggagtgaaacagtctggggatagactgtttcagctcaacaactggaaataaggacttgttgacgaactctttttagaccagtcgagttctttctcactcccacttcttcagttgtttataaatcaagcctgcgcttatcaaggcacagccgatggcgtaaataccaaaggcacctgttggggttgggttgagtttttccagataagtcggcaagatagcagatgtcgcaccgccgatattgcagcccataaggacgattgtcatgaccgcattgagcaaggccttgggtgcacggtctgttacctgactaaagacaatggttagaatgatgctgtagaaaaatcctgacaccatgccaccgagtcccagcacccagagattatctgcaaaggcaatgccgacaaccgcgagtccaaagaccacgtaggaaacagctaaaagccagcccttcaaacgaccaaccaagctactaaagaccgtccctgccacaatccccatgacctgcataagacttagaatgagactggcttgctgagcagtaccgatgcccttggctaaaacaatctgaggaatacgaatggtcaggaaggtattgacattgataacaaagaaggctaagaatgccagataaatgcccatcatccacatggtcttgtccagtttgaccttgggcgcgttctcctcaacctttacctccatgcgagacagcaattcctccttgggtacgaaaataaggaagagagccaagatgaccaaggcaaaaaggtagaccaagaaggcaggttgccaaccaaactgggtcaaccaaccgacaagtagggtaagccctgcacttcccaaaacctctgctgaaccacgcaagcccatcatctgcacccgctcctgaccggtgaaaaaattaccgatgatattaatagcacgcgcattgattaggccaatccccaaaccaagcaagatgcgagccaataaaatcagaggataagcagttagaaacatgggcaaagctccgccgatggccataagcaaaagccctgcaatgataatgtttcgttcagacaagaaacggacaactagaccgtttgccaatagagtaaccataatagcaaaagaggtcaccgtaattaagttttccacctgggccgctgcaattccctgctgggcaaaatactcaatcatctgtggaatagctggcgagacagcaaatgtcgaaaccagcatggtggatagggccagcaaactggctttttctaaaattcttttcatttttctccctttcaacgttcgtcttttactagtataacagatttgaaagcgaatggatagaaaagtccgacttttattctctcccatttcatgctatacttatcttaactatattcaaaggagagaatcatgtctgttattgaacgattgacaaaagctgcccatttgattgacatggatgacatcatccgtgaagggcatccaaccctacgccaagttgccgaagaagttgcatttccactatctgatcaggaaattattttaggcgaaaaaatgatgcagttcctcaaacattcgcaggatcctgtcatggctgaaaaaatgaaactccgtggcggagttggtctagctgcacctcagattgacgtttccaaacgcatcattgctgtcttagtcccaaacccagaggacgaggaaggaaatccacctgcccaagcctactctctgcaagaagtattgtacaatcctaaaatcgtggcacattctgtccaagaagctgctatggaagggggcgagggctgcctatccgttgaccgcgaagtccaaggctacgtagtccgccatgcgcgcgtgactgttgattacatggacaaaaacggagaaaaacaccgtatcaaactcaaaggctttaatgccatcgtggtccaacacgaaatcgaccacctcaacggtgtcatgttctacgaccgcattgacccagaacacccatttgccgttaaagaaggcatgttggtaattgaataaacataagaaactgactgaaaaattttcggtcagttttttatgtgagtacgaaaaaacgaccctttcggatcgatctcaataatagtcttttagtttacttttagtactaggcaacgagccgcaggcataactggagttaggcaaggtgagttaacgacgtaataaaagataaactaaatgacgatatcttagtaatattccccttgtctgtagtcccaagagttgaaatggtcagacaagtgcatcatgattttatcaatgtccagacccttacggatgacaactggacatgggctgatagaacggctatccgcgctttgttctggaatgagtttaccatctttgtctaccatagacaccataaccccttgctcatagcgggtttcaatggtcttgtctggctggatagatgtcacataatcatccgcctcgataatcaagtccactttagaagcgatacgctcaccgataccttctaccttgccacgatttcccttacctgacgggttagcagatgacgcatagaccatacggccttctttttcccacatttccttagcaatctgctcgcctgctacaccaaacttgataacaaagcaagaagtaccacgaacgtcggtcatcaactcttcacgaccatcgccataagcctgcaacttagcataagcctctggtttccacggcaggatacaacccaacaaaatgtcctcatcccaatgtttttggtagaaggcatcaatctcaggagtcaactgtgccaactcacgaagctcctccatgctaccacaaaggacaacgcctggcttattccgcttgcgctccttagcatcaaacttacgctccaagccagccttgtcagcagtcatgatgatgtaaccaaccttggtcgggcagacaatcacgcctccctcacccttgataatgtcaaaaccttcttgtgaaagtccgccatcccagtgaatttgtttcgtcataataatttcctcttttcttttgttccatagcagagcgatctgcttgttttctaatatttttagttttgccagtagcttgggcgattatcctcatactcagcaatcaaatcctgatactgtaaggtaataccaatatcatccaagccattgagcaacttgtgtttccagtcctgttcgatgtcaaatgggcattccccaaaaggcgtccgtatcaactgatctgccaagtcaaccgtgatttcttggtcaggacccagctgagctagttggtccctgacttctttgggctggataatgggcagaatcccattgttcaagtcattgttgtaatgaatatctccaaaggagcctgcaatgatgaccttgaagccataatctgccagagcccaagcagcgtgttccctagaagaacctgctccgaagttatccccagatatgaggatactagcgccttgatactcaggctgattgagaatgaaatcaggattgtccgtgtagttatcatccaagtaccgccaagcatatagcaaatacttgccaaagccctttttgtcaatcagcttgagaaactgcttgggcaggagctggtcggtatcaatattatcattcatgagtggaacggttgtccctgtccatgtggtaaattggtgcattagactcccgccttgagaatgtctagctgtctggtgtcgacaaaacgtccataaagcgcagctgtggcagccatagcaggactacacaagtgggtcttggccccaaagccctgtcggtcttcaaagtttcgattacttgtagaggcgcagtggacacccgcagggaccttgtctagacctaacttttctgcagcacgcttgacagggcgactgcctggtacgacaatagccgtaacctgctctgctattttccgccccttaacaatcctagctgccagctgcaaatcgctgaggcgagcattagtacaggagcctaggaagacatagccaacgggaatgtccgcagccttttgcccaggagccaagtccatgtaagcatagacccgctcgtcgttgtggtcacggatggatgggaaagtttcgtcaaagctaacccccatagcaggagtggtcccccaagtcaccatgggtgccaagtccgacacatcaaggaccaggtgcttgtcatagacggtgtccgcatccgagtagagctccttccagtctgccaccgccgcatcgaagtccgctggtgcacactcccgacctcgcaggtagtcaaaggtggtctggtctggagccatgatgcccattttggagccgaactcaatggacatattgcagatggtcatccgctcttccatgctgagtcggtcgatgacgggtcctgcgaactcgaccacatgacccaaaccacaatctacgccgtagcgggcaatcagagccaggataaagtccttggcatagacacctctttgcgcctgaccgacaaactctactaggagtcgcttaggtttgacctgccaaatggtctgggtagcgagaacgtgctccacttcagaagtaccaatcccaaaggcaatagccccaaaggctccgtgagtcgctgtatggctatctccgcagacaatgaacttacctggctgggtcctgcctgtttctggtccaaccatgtggacaatcccctgatgttccgaaccatgggctgcgtggggaatgccgaaatcttctatattcttagccaaggcatccatctgagccttggaaatgacatcacggatattgtgaatatcaacggttggcacgttgtggtcaaaagtcgcaaaggtcaagtctgggcgccgaacagatcgccctgtatccctcaatccttgaaaggcctggggactggtcacctcatgaatgtagtgctggtccacatagaggagctggggctgaccttcttgccctgtaatcacatggcgatcccagagcttatcaaaaatagatttgccactcatatttacccacctccaatttgggcaataatggccgctgtcatttctttggtagatgcgctaccacctagatccttggtaaaaatgccctctgcaaagactgcttcaactgcctggcgaatggtctgacctgcttggaccaaatcaaaactttcttccagcatcatggcaacagatagaatcatactgacaggattggcaatgccctgacctgcaatatcaggagccgaaccatggataggttcgtagagactgggacccgccaccgcatgactagcagaaggcagaacccctagcgttcctgttaatacgctggcctcatccgacaaaatatcaccaaagagattttccgtcaccaagacatcaaaccgactaggattggtaatcaaaagcatggctgcgctatccaccaactggtgctccaagaccacatctgggtagtccttcgctacctcatccgccaccttacgccataattttgacgttgctagcacattttgcttatcaatactggtgactttttttcgtcttttttgggctaggtcaaaggcagagcggacaacccgttcgatttcctcagcttgataggtattgctatcgctggcttggtcagttccaaggatatgctctccaaaataaatcccgcctgtcagctcccttaccatgaccaaatccacaccgtccagccggtcgaccttcagaggagaatagtctttcaggctatcaaaaattttcaccggacggatattggcaaagagacctaattccttacgaagttgaagaagaccttgttctggacggacagcggcatcatcatattgagggctaccgatagctgctaacaaaatcgcatccgccttacggcaggcttgtaaggtttccttaggtagagggtgcccgctcgcatcaatcccagcgccaccaaaggctctctcctcaatctcataatcaaatcctacttgcccagccacagcctcgaggactgctaggccagcctccatgatttcaggaccgattccatcaccagccaaggctacaatttttttcgtcatatttcctcctagatgtgtggtaactctttctcagatagtttcttatcaatctgtccgctattttctttctgtaccatgacattggcatgaatataggcaatggcagaagccttcaccacgtcaaagtcaataccagaggcattaaagaccgtttccgttgccttgttttctacggcgacaagcacacgcgcctgggcatcaattccatcggtgatggcgtcaatatggtagcgttccaagctaatctcttggtggaagaattggtcaatagcattaaagacagcctcaacagaacccttgcctgactccgaaacaaccacttcttcctcatcctgattgatgaagatgacctgagcctgaatacttccgtcagactgactatccaaacgcaaatctttaaattggaagccatcacgattgctgatttctgtcccagctactagagctcgaatatcagcgtccgtgattttttccttcttgtctgccaggtttttgaaacgagcaaacaagctagcaacgtctccttcttcaaaatacaggtctagttctttcagcttttctacaaaggcatggcgaccagatagtttacccagtggcagagaatttttcttgacccctaccaactcaggtgtaatgatttcataggtcgatggatttttcaagacaccatcttggtgaattcctgactcgtgagagaaggcattgccaccgacaaccgccttattgcgtggaatggcaatcccagaaaaacgagatactaattccgaagtattgagcgtttcctttagaacaatcggactggtcacatcatagaaatctttccgaatttcaagggcaacagctacttcttcaagggccgcatttcctgctcgctcaccgataccgttgatagttccctcgacacgaccggcaccgtttttaatagctgaaagggtattggcaacagccattcctaggtcattgtggcaatgtggactgaaaataatctcacggtccgatttgacgtttgttgtcaagtaacggaaaatttctccgtagtgctgaggagtcgtaaagccgactgtatctggaatgttgatgtaggtcgcacccgcatctaccgctgtctgcacaacttctagcaaataatccaactccgtccgcgtcgcatcctctggtgagaactccactacctcaaaacgctcacgtgcatagctgacatgttcagtgatttgcgccaaaatttcttctttggtcttttgaagtttaaattcacggtgaatggggctagtcgcaatgaaaacatgaatctgcggatacttggcatctttcagagcctcataacaagcatcaatgtctgattttactgaccgtgccaaacctgtcacagccgtcttggtcatcgctgccgcaatctgacgaaccgcttcaaacgaatcaggactggccgcaggaaaacccgcttcaatagcagaaatcccccatttttccaactgcttggcgatggtcactttttccttgatagaaaaattcacacctggcgtctgttcaccatctcgtaaagtcgtatctaaaaattcaatcacacgcataagaatacctttctaaataaccctaacgtcaatattaggttctctttcttagttttcaaagtatactaagaaaaagaaaacacctcgaggactattacctgcgagatgttgtcaacagcgcccgcttggtaagccaaacaggactaatgctacctagtgcactagcccgaccgtcgcaacaacaaagcaaagaattttgtagtgacaggtttcatttgactttttcctttcagtattttaattatttacaatgataccctacttattttcacttgtcaacagaaaaatggaaattttctgaaaaatccgaacaatgcggcaattcgtacaaatccagataatagaaaaccatgctccaattgaagcacggttcaggtgtttaattccgtctagaactgctaaaaatcgccactaagagaatagcccctagaacagacggcactacagccataccagcaaactgtagtccccaatcaccgaagagcagttgtccaatccacgaaccagcaagtccaaggatgatatttccaagacaaccacgacggtcatctgatgaggtcaaagcccccgcaatcaagccaataatggctccagcgattatacttgataacattctattttcctccttatttacaaaataagactggtctcccagtcttatagcattgtttttagatagcccactcaccgtcacggaagattggcacacgagtaccgtcttcacggattccgtcaatgttcatcttgttagaaccaatcatgaagtccacgtgaacatctgagcggttgagaccagcttctttgagctcttcttggctcatttctgtaccaccttcgatagagaaggcataggcttgaccaatcgccaagtggtttgaggcattttcatcaaagagagtgttgaagaaagttacacctgattgagagattgggctcttatctggtacaagggcaacttcacctagaccgcgtgcaccagcattgtcaaagaccagtttcttcatgacttcgtcgcctttttcagcagtcacatctacaatctcaccatctttaaaggttaccttaataccttcgataatattgccgttatagctaagaggttttgtagaagttacataaccatcggccacacgatagtcaggagctgtaaagacttcttctgttggcatgttggcaataaacttctcaccttgggcattgatcgaaccagccgcttcccataagtggtttttcggcataccaagaacaaggtcggttcctggtgctgtgtagtgcaatttgacaaactgctcgtcgttaagaaccttagcttttgctaccaaacgtgcttcatgctcttcccaggctttgattggatcttcatcgtagatacggcaagtcttgaaaatttggtcccaaagtaagtctactgcttcttcgtcagacgttgcatttgggaaaacttttttggcccattccaaaccagatgctgcaccaagtgtccagctgattttgttagcttgggatgcttgccgcattgggttcaaagcctggctgagtgcacgagcgttgcgagacaatttctctggatccacaccgtcgtaggcccctggatcttctgacaagacaaccaaacggctggccttccgctccaagaggtagttcatttcagtgatgcgttgtgggtgaacttgttccaagagttccacatctacattgaccaaacgctcgcgcgcaatcacatcgtccaaccagttgaccaagacttccttagcaccgtgagcgtaagcttctttgacaatcaagcgtgccaactcagcctgttccacaccaattgtcaattgaaccgtgtgaccaggttggacattgatacctgttgaaaccaagagtttagcatatttagcgagattttctttaaaatttggtaataccatctttttctcctttgtactttgaaataccctattattgtatcatattttaagctagacagataaaaaaacttcctgctgatacaggaagttgaaaaggttagctctgggagatagttgaagcttggagatgaaacgaatggagttcgtgtcaacaagctgcaggcataaccctgctcctctcttgttttaagggaacaggctgaaaaactccactggagctttacactcaccacatcaagtcaacaacgtctgatcccaattttcgcagagtattagttaccaaaaacctttacacggtcagaatccgccatatagtctttgtctgctgctggagctgcaatgcttccgaatggtgcttgggcgcggagtttccagttagctgggataccgtatttttcagcaacttgtgcatcaaccaatgggttgtagtgttgtacgttcataccgatatttttctcagcaaaggccaaccatactgcgtacaagttgataccatgagcttgttcaaaccagattgggaagttttcagcgtaaagtgggaagctttcttgtaagcctttcaccacgtcttggtcttcgaagaacaagatagtaccggcaccagccgcaaaaccagctaagcgaccttttgtagcttcaaaagcttctgcaggcgttactttttccaattcgctgtaggcaatttcgttccagaaaacttctgactccgcaccaaaaagtaccactgcacggctagattgtgagttgaaagctgatggagattctttcatggctttctcaacaagtgctactacttcttcatttgatactggcaagtctttaccaagtgcgtagattgaacggcgagtttcttgaagttttgcaaagtttgacatatgttttcctcttttctatttgttactacatagtagtttttatcactatagggagattgtatcattattactaagtagtgtcaaattcctagtctgacttttttatactccgtgaaaattaagctagttacagcagatagtctgattttcataaagtagtgacagagaatttacaaaaagatggcaaaaaaagcctatcaaatacttaagatacattgatagacccttctttatcttatagccccaacatctcgtctgtaaaatcagtcagcgaatgttccttataaaattccaagtccttcaggcgaatgattttggcaatgacgctaatcggaaactgatgcaacagagtattgaaatactcaacctgctgattgtatgaaatcttccattgtgctaaattattttctgtttcaaaaatttcattcagtaacctttcaatatgtttattggccatcaattccggcatttgacgcaaaaattgaccaaattcttgtgaactttcaatcttggtggatttcataacagttttttcttcaaccgttcgaattttggaaacggatttattgatgtccaaaatggtttctttttcaagattctggtgtttttcaaccaagcggtttgctttcttcatcaaggcctgattgcgctcttcaataacaacgatatgacttttactagctttcgcggcttgttcagcctgacgaagttggttatacttcataatgatatggagaatgaaactcgttagtataccagcaatcacagtaaaacctggaaaaggttcgtaaatacctgatgatgattccggtgtggcaaaagataagatcaatgtccacaagatagtagaaagcagtactagaccaattccttttaataactcaactaaaatatttctttttttcatcatttccttttttaaaacaaatcatcaaagagactcaactggttatcctctggcattttaccgaggatgcccatttcatccattttttcaacaagcgtacctgacaatccaccacgtttacggagttctgtcttggagagaaattctccttcggcacgcgccgccacaacctgcttggcaacgttctctcccagaccatccatagcgacaaatggtgggatgagggtatcttcttcaatcagaaagtcggtcgcatgggatttgtagaggtccaacttaccgaacttgaagccacgttccagcatttcatttaccaattcaagtgtggtatagagatcctgctcaacgttcgaagcttcattgtttttcttcttgagggcgatttcttccatcttagccttgactcgttccaagccaccggacatggttgccaaatcaaatgccttggcccgaatagagaaataagcgcaatagtagtaaagtgggtgatgaaccttgaaataggcaacccgcaaggccatcataacgtaggcagccgcgtgggctttagggaacatgtacttgatttttccacaggattcgatgtaccagtctggcaccttgttatccttcatggcttgaatgtagccatttcgctcttcctcagaaatcttgagccacaagcccttccgcacccgctccatgatattaaaggccatcttaggtggcaaacctgcgtgcatgaggtaaaccatgatgtcatcccgacaaccgataacagtagatagattagcaattcctgccttaatcaagtcctgggcattgcccaaccaaacgtctgtaccgtgcgatagaccagataactgcaagagttccgaaaaagtggtcggtttggtttcctccaccatcccccgtacaaagttggttccaaattcaggaatgcccagcatacctgtcggtgtcccaatctgctctggggtaacacccagaatttccgtaccagaaaaaagagccataacccccttatcatcagcaggaatagtttgcggatcgatgcctgacaagtcctgcaacttccgaaccatggttggatcatcgtgtcccagaatatcgagtttcaagacgttttcatcaatatcgtggaagttaaagtgggtggtctgccagctggctgtcacatcatcggcaggatactgaacaggggtaaagtcatagacatccatgtagtcaggaaatacaataattccccctgggtgctgaccagtcgttcgtttgacaccagctgctccagcagccaggcgttctacttccacatctctatagaatttgccataatcccgctcatagcctcggacaaaaccataggcagtcttggcagctaccgtaccaaccgttcctgcacggaaggcattttcttcaccaaaaatatcccgaacatccaaatgggcagacggttggtcatcccctgagaagttcaagtcaatatcgggaaccttgtctccatcgaaaccaaggaaggtctcgaaaggaatgtcctgtccatcttttttatacttggtcccacacttttcacaatccttgtctggcaggtcaaaacctgaaccataggaaccatctgtgataaattcactgtgttgacaatttggacagacatagtgaggaggcatagggtttacttcggtaatcccaatcatggtcgcaacgaaactggagccgacagacccccgtgaacccaccaggtagccccgctcgttggaacggtgcaccaacatctgcgatgccaggtaaatcacggcgaatccattacctaaaatggaagtcagttccttttcgattcgcaggtcgataatgtctggcaaggggttgccataaatctcaaaggctttctgataggtcaattccgcgaccgtttcctcggccttctcaatataaggcgtataaaggtcggtcttaaccacctgaacatcttcaaaccggtccagcatggcattgggattggtaatgacaatctcacgggccagactttctcccaagaatgcaaactcgtccaacatctcgctggtcgttctaaagtgggcttttggcagtggtgctggctgagcgttttcaccatttccgatggtccagttaatcggtgccccttgacctagagcacgaacaatgatttcccgataaatttcctcttctgggtcaatgtagtggacatttccagtcgccagaacaggcagacctgccctacgtcctacctcaatcaactgcttgatagtctcttcaatctctgccatgtccttaaactgctccttggcaatcatgggagcatagagggcaggtggcataacttcgataaaatcataataggctgccgttttaaccgcttcatctatccctttggagagcaagtcatcgaagacctcaccctcttgacaggctgttcccaatattaaaccttcacgatgggcattgagaacggtccgtggaatacgtgggactccctcaaaatacttggtattggaaagagagaccagtttgaacatatttttcaaaccaacctgattaatcacatagagcgtggcatgcttgacacgagccttcttataggaatcctccgcaatcagctccgtatttagctggttgagattggtcaaattgtgcttctccagagcatcttttaggaagatgaagagcaggcgccctgtcgcctccgcatcgtagttggccatgtggtggtgttcaagagcaacaccaaaccgcttggtgagaggacctaaaccatgacgcttaaagtcggggtaaaggttacgagcaaattccaaggtatcaatgacaggctggctaataataggtaagcctgctcgttcatagttgacattcataaagccaacgtcaaaggtcgcgttgtgggcaaccatgacggaatcttgacagaaatcttgaaactcacgcaggacttgttctagaggtttagaaccacgcacatgctcatctgtgattcctgtcagatctgttgtaaattgactgagcggatgacctggatcgataaactcatcaaattctgcaatgatattgcccttgtgcatcttagacgccgcaatctgaatcagggcattgttgactgcagacagaccggttgtttccacgtcaaagaccacataggtggcatcagacaggactacatctgcttcgttgtaagcaatgggcacagagtcctcgacaatattagcctccatcccgaagaggggcttaatcccagctttacgagcagcatgatagccatgggggaaggactggacattgccgtggtcggtaatggccaccgccttgtgtccccaggctgccgcacgcgccaccaagtcctcaacggcaggcagggcatccatagtggacatgttggtatgggcatgaaactcaacccgcttctcaccctcaggcatgagatctttgcggatttccttcttgacctcttggacttcctgtacgttcatagtcaaatcacgagtgaaattattggtttccacattgcctcgcacccgcagccagtttccctttttgaccatatcaaacttctgagcctcttcctcattcttagcccacttctgcaaggtgaaggacgaagtatagtcggtcatcttaaagttgataatgacccgccccgtcttggtcgtcttctgctcgacctcaaagaccagtccctcaaagacaatccgattctcctcgctatccacctcaatcataggcgtaatctcagccttttcgatattgaccttggcaggacgatttttcttatattctgggacaaatggctgagctgcctctggtggtggcgccatttgagctagttgttcaagggccgccaagttttcttcattagcctgctggtaaatttctgcattttgcgcatggaaaatctccgcttgttgctgcgtcatttcctgacagacttggatgtccaccgcaagattaccaaaaccaaatcgcttgtattgctccacaagatttggcagatgattcttccgaaaatgatctgtgtcaatggtttcaggaccttttatccacaaaacaccatctctataagccacctctaatggctgaaaaagggccttgaagcctgcactctggcacaaatcttccgtaaaagcttctggataatatgcttctaccaaaccagcttcaaaagcctccgcatcgctgacaatagaaaattgaatcttattgcccaccttttcaaactccgtcgccaaacgagccttgaagagttgatagtccatgagcggcaagggggtttcaaaacggaaggtaaattcccaaagtttgctaaccttgtgcaagactactttctcaatcgttgcagtcgaaaaagcccctgattgtcgtgcatcaagaggcattccgatttgttgtagcaagagttgaaacttatctgacatacttatttcctttgtagttcgttagaaacattttaccataaatgaggtattttttcctgagtcaggaagaaaaaactctcaggttcatttcctgagagatctgatttctatagaaattggtagcctaccaagccgcagcttctgtcggtgcttctaaaaagtccagccattttcgatccttgacacgacagagggtgacagaaattcctcccatatcaagactggtcataaatttacctgtttttacataggaaagctgtaaaccttctagctctagaaattggcaaatgtcgttcaaaaagattccttgctcaacctcggacatagatccaagattattgaccagaagaatatagtcttccccttccttccagcggaattttaattttaatttgttcacaatttcgttggctaactgctcagaggattcaaaacgaacggtccgatagccttcttctccatggataccgataccgtaagatatttgtccctcctccaaatcaaacaaaggcagggcagcattgggcaaataggccgacttggttgcaaaaccgatggtcgcaatctctgttgccagagacagtcccagctgttccaattcatctaggctatagccagtaagggcagcagctcctaatatcttatgaagtagaatggtccctgcaagccccctatgccgcatacggaaattattcttagtatcgaccgaaatatcatcatgggatacaatgtacttgactgcaattccctcctgccgagccaattcgatggcttttctaaaagagataaggtctgcctcaaagttttttacaatcagaaaaactcccttgcccttatctactgcgcgaatggctgcaaatacttcttcagcggttgggggcgtaaatatttcaccatatactgcagcagtcagcataccctttccgacaaatccaatatgtgccggttcgtgccccgatccaccacctgaaataattggaactaaatggtcatcctgcactttctgaagcacaatcggaagtcccttcactttcttcactttaggattagttcgacagaaaccatccaaataatcttcaataattgttgcctgtctatttctaataaacaccatatattaactcctacaaaatcacaaacgactcgcgaacaagagccaccatttgcttccaataactgtgaatctgacaaggtgactgtgtcagtccttcctttatcagtccaatccaagcattagcatgatagagaatcaaaaaatgcttatcctgttgggaaatcattttaccctcctggagctggtactcgttgataattttctccatcaaaaccataaagtagccttctaaatagctgacaaaatcattttgccccttaatctcaaagagttgcctatagaaagattggttactctcgatgtagtacaacagctcatccagaagcttgattccactaatataggtcagattgtcagttacctgctcctgcaattctgtctcaaatatccagtccagcaactcatacttgtctaaaaaatggttgtaaaaggtttgacgacgaatccctgcttcctgcatgatgtcgacaactgagattttatcaaaggatttttgggatagctgttttttaaaagcctttgcaatccttttctttgtaatcaacgaggttggcatatgtcacttgtcacttcctttcgcttcctctttattataccctatcatgcttttctttggaacaaaagggacactttggacaatctgtcccttccttttttcttttggacaatgtaaaatgaaagcgcaaacaataacaaaggagttttctcatgaaaaaaattatcaatcaacccgaacatgtcgttgatgaaatgttaaaaggacttgtctttatgcaccaagatcttgtcgatcgtatcgatggatttgatgtgattatccgcaaggctgaaaaaactggtaaagtcggcatcatctcaggaggtggctctggtcacgaaccttctcatgcaggctttgtcggcaagggcatgttgtccgccgctgtatgtggcgcagtatttacctcaccaacaccagaccaaatcttagaagccatcaaggctgctgacgagggagctggcgtctttatggtcatcaaaaactactccggcgacatcatgaactttgagatggcacaagaattggcggaaatggagggcatcgaagtggccagtgtcatcgtggacgatgacatcgctgtggaaaatagtctctatacccaaggccgtcgtggtgtagctggtaccatccttgtccacaagattctcggtcacgctgcaacaactggcaaatctctagcagaaatcaaggaactggctgaccgtctcgtcccacaaatcaagactatcggcttagccctatcaggtgctacggtaccagaagtgggcaaaccaggcttcgtccttgaagaggatgaatttgaatacggtgtcggtatccatggtgaacctggctataagaaagaaaaactccaaccatctgctaaattggctgaagaattggttgagaaattggcagaaggctttgatattcaagatggcgaacactatggtgtccttatcaacggtctcggcgcaactcctctcatggaacaatatgtctttgccaacgacgttgctcaattgctggctaaaaaaggtgtggtcgttgactacaagaaaatcggtaactacatgacatcgattgatatggctggactgtcattgaccttaatcaaactagaagacccaagctggattgacgctttgcaggcccctgttgaagtggtagcttggtaggagaaagactatggatgcaaaacaagcattgctctggatggaaacattcaacaaaaaaattcaagaaaacaaagattatttgagtgagctagattctccaatcggagatggagatcacggaggcaacatggcgcgaggaatggctgccgtcatgcaggagctatctgaaaaagactatgagactgctgaccaagtctttaaggtggttgccatgcaacttctcagcaaggttggcggtgcttccggtcctctctacggctctgcctttatgggtattactaaagccagtcaagctggcgctgatttggcagatacgcttcaagcaggtttggacatgatccaaaaacgcggcaaggctgaattgggcgagaaaaccatggtagacgtgtggattcctgttatttctgccctaagagaaagccagctgacaacggaaattatccataaagccgttcaagggacaaaggatattgctgcgaccaagggacgcgcgtcctatgttggggaaaggtctattggacacattgatccaggctctttctcatctggacttctctttgaagccatgttggaggcaggactatgacaaaggttggtatcttactcgtatcccattcaaaaaatttggcccagggaatcatcgacctagtatctgaagtcgcaaaagatattcccatcacctactgtggcggactagaagatggtagcatcggtaccagctttgaaatcgtacaagagcgagttgaagcaaaccctgctgataccctccttgcctttttcgacctaggtagcgcccgaatgaacatggaacttgctgccgattttacagacaaacaaattcttatccaaaccgtaccagtcgtcgaaggttgctatactgccgcagctctcttacaggctggagctgacttggagactattcttgaacaattaaaagaactgacaatcaataaataggaggtcattatgaatctgattggagaattacttggaactttcatactagtattacttggaaacggtgtggttgcatcctgcatcctctctaaaaccaaggctgaaaatagcggctggctgaccatcgtactaggatggggcatcgctgtaacaattgccgtctacatatcaggaatttttggacctgcccacctaaatccagctgtcactatcgcaatggcatctatcggctccctaccatgggctcaagtcccaggcttcctacttgcccaatttgctggagcaatgttggcatccatcgtcctctatctccatttctacccacattggcaggaaacaaaagatagcggaacaatccttgctaccttctctactgcaccagctcttcgtcacacagcttcaaacttgctcggcgaagctcttggtacagctgtcttagtcatgggaatccttgcaattggtcctaacaatgtcagcgctggcctcggcccaatcatcgtgggacttatcgtatttgcaatcggcttctcactaggatcaacgacaggctacgcagtcaatcctgctcgtgatttaggccctcgtatcatgcatgccatcctacccattccaaataagggagattctgactggtcttatagctggatcccagttgctggcccaattcttggaggtgtcgcaggagctatcctctataacatcctactaaatatgttatagtcatttgaattaactttgatacatcgtcactttcggcttgccgtactatagtacagcctgcacctcagttccttgtctgaaagctaattcattcgactatataaaaaataggcttgggtgactagaaccactcccattttatcaacaaagacttggctatcatcaaccaagtctttttctgttattcattttcttttgtaaggatttgcaaggtttcaaggagttggtccacatggacttctacagtatcacctgtacccttgattttcacttcgacgatgccatcagctgctttcttaccaacagtcacacggattggcaagccaatcaagtcactgtcagaaaacttaacgccgacacgctcattacggtcgtcagttaatacttcatagcctgcaccaaccaaacttgcttcgatagactgagtcaattccatcgccgcttcatctttgacattgactggaatcaaatgcacatcaaacggtgccaattctttagggaagttgatcccccaagcgtaacggtattcgccttttggtgtcttgttaacaaagaggcgagcgtgttgttcaagaacggctgacaagagacggctaacaccgattccgtagcatcccatgataatcggcatagaacgaccattctcatccaagatgttggcattcatgctgtctgaatagcgtgtaccgagtttgaagatgtgaccaatctcgataccacgggcaaagttgagaaccccgtgtccatctggagaaggctcgccttccttgacttcgcgaatatccacatactcagtcacttggaaatcacgccctgcattggcacctgtgtagtggaaaccatcttcgttagcaccaactacagcgttcttcacatcttgaaccttacggtctgcaataatcttgatgttttctggtaaaccaactgggccaagagaaccaaagcctgcaccgaagactttctctgcatcagctgggcttgctacatcaaagaaatccgctgccaagtggtttttcaacttgacatcattgacctgatcattgccaacaaggagggcaacaactggctctccgtcagccataaagagcatggttttgatagtttgttcttccgcaacgttcaagaaggcagcaacttcgtcgatggttttggcatctggtgtagcaactttaaccaagtcttcttcaactacaactgctgtacttggtttgtattcgctagttgccatttctaggttggcagcgtagcctgattcgcttgagtaggcaatggtgtcttcaccagacacagaccaagccaagagttctgccttgaacgcttcaagaacatcctctgggatttcctcaaaagaagcaaccgacttgtccaagacaacccaacggtcgagatcggtacggtctggtgtaatagccataaactcctggctatccttaccacccatggcaccaccgtcaccgataatagccttgaactccaatcctgcacgagtgaagatcgcctcgtaagccgccttgtagtcatcgtaggtctggtccaagctctcataactagcatggaagctgtagccgtctttcatgataaactcacgaccacggagaagaccgttacgaggacgtttttcatcacggtattttggctggatttggtagatgttaagcggcaactgcttgtaagactggaccgcatcacgcgccaatagcgtcaccgtttcttcgtgggttggacccaagataaagtcagaaccttcacggtttttgagcttgtagaggtcgtcaccgtaggtttcataacgacctgactcacgccaaatatccgcggacaagagggctggtgccaaaaattcaatggcatcaatcttatcaaactcctcacgcatgatattttttgctttttcaatcacacggttagccaaaggcaagtagctgtaaataccagcagaaatctgacggacatagcccgcacgtaacatcaaagcgtggctaattaccgacgcatccgaaggcatctcccgcaaagtagggataatcattttagactgtttcatagttaagatataagtgcgttaagaaaacgaaacgaaaataggaaacctaacgcagtgcctttggcactaggcaggtttatctttttcgtaaagtttttagcacgcattcaattcctttcatcttttgtttatcaggaatgcacaggtttcagcccgtgttcagttcctttcttagttttcagaatatcctgcgttcagcacgcattcaattcctttcgtatttttcagaatatcctgcgtttagcacgcattcaattcctttcataaatttcaaattatcttagaagaagactcttataatatcattccaagtgactactatcataagaaccaccataacggctacacctgctagagtgatataagattccgtctctggtttgagtggttttctgcgaatggcttccagaatattcataacaatcttaccaccatccaaggctggaattggaatcaaattgaagattccaaggttaatggagagcgcagccattagccccaatacagaaaccaaaccaaattcagctgcttgagaacttactttataaatagcaaccggtccccccaactgcttaacatcaaagtttgcaattagattcttcaaagctgttacaaccctaagagctgtcgctcccgcttcttggaaaccaccgacaattttatcaacgaaaccagttttcaaaatcggtgaaataccaattcgataggccccatctacttgttcagcagtaacggagacatgacggtttttcccatcatgctcaacgaccaaatcaaagcttggggctgttgttgcatctgttgctgctttactaataatcgttgcaacttctgtgtagctgtctgtcgtgttcccattgaccgaaagaatcttgtcccctgtgacaacacctgcagcctgcaaagcaccaccttcagtaatacttactgcattgcttgatgggttggcaacccctccttgcatgaagaacaaaagaataaatactagaatccctaaaataaagttattcatgggacccgcaaagttggtcatcaaccgtccccagactgtcgcattttgatattgaacatcaagtggagcaatccgaacttctgttccatcttcctctacaatcgtggcatcgtgatcaaccttataggtcttgctttcttccaagaccaagcctgtgatttccaatttttcctcgaagtcaaaactggttacattcattggcaaactgagactatccagttgcttaccagacaaattaatccgcgtcacaacaccagcttcattcaggctgaggctggcaggactacctgtcttaatctctgtcttatcttcaccccatccagccattcgaacatagccacctaggggaaggatacggatggtgtaaagtgtcccatccttacctgtatgagcgaaaattttgggacccatcccaatcgcaaattccctcacaaggataccagctttcttggcgaagtagaaatgaccaaattcatggacaaccacaatcacaccaaatataaatataaatgctaaaattcccttcatagtacctccttaaaataatccaaagaagtgcatgattggaaagacaaaaatcataccgtcaaaacgatccaggataccaccgtgtcctggaataatttttccagaatccttcacaccaaaatggcgtttaatagcactttctactaagtctccgaattgtgagaatatcgagaaaatcacaaccaacaacaacatcatgccaaatgaatagcccgctaacaaggacttatcgacaatcaagaaaatgatagcaactaccaccgcagaaagaataccgcctacaaagccttcaaccgttttattcggtgaaaccttcggcaataattttctccgaccaatctgacgaccgattaagtaggcaccaatgtctgttgcccagactagacagagggcaaagaagactttattgagcccatccatacgagccagtatcaaactatgaaagccgataccaacatagaaacttgatgcaattggaaagacaacatcggaatagttgtaatgaccgatattaaaaaccgtcgaaccaagcagtaaaaatactacaatggcgtaggctgtgtaatttccatccgtcggtaaaaatgtcaaataattctggagcggaagagccaagactaaactggccaacatagctaagacaccctcgatagaatttggtgctaggcgatacattttaatcaattcagccgtagcaataatagctaacaggcctacaaaaaattgaaatgccatcccaccagccaacaaaaagggaatgaaaatagctagagcaatgccgccaaatatcactcgtttctgtaaatcgtttgtcataccttctccttatacaccgccaaaacgtctgtggcgacggttgtattctttaatcgctaatttaagtgcttctccatcaaaatcaggccaagcaatatctgtaaagtacagctcgctgtaggctgtttgccacggcaggaagttgctaagacgaagttcaccacttgtacggataactagatcgggatcgcgtaacgttggtgataaggttcctgtatagaggtaatccgctattaatttctcatcaatatctccaggattgaacttggcatccaagacatcttgcgcaatagccttgactgcgcgagtcacctcatcacgaccgccatagttaagagcgaaattgagaatcaaaccagtgttaccctttgtcttttgttcggctttataaagcgcattgagagtcgggacaggaagttttgaatggtcaccaatcatctgaattttgacattattggcatggagttcaggaacatacttatcataaaactccacaggtagattcatgataaacttcacttctttttccggtcgagaccagttttctgtagaaaaggcatagacagttaacacctttactcccaaatcagaagccgtcttggtaaccttttgcagtgcatccataccagccttatgccccataatacgtggctgcatccgctttttagcccaacggccattgccatccataatcacagcgatatgcttagggacttcaattgctgtttcaatgctttctttctttttaaaattaaatttaaacatggtattttccttattgtataatcgtttcattataccatatttttacctaggatagcaaaaatcaggcagggctaaaacaagagaaaaccaaggtttccctcggtttctcatccttattcttcaattgcagattctggagttgcttctggcgtttcaactgccacttcttcaacaactgccgatgtagcatctgaacttgctacacgatcacgaatagcaccacgttcaaatgtcaagtaaacaccatcaacatcgagaacaaccttcttatcatcgatttcatcgacaataccaaatagcccaccaatggtcacaatttcatcaccttttttgatttgatttagtgcttcttgacgttgtttttgttgtttacgttgcgaatagaacataaaaccaatcatggcaaccatgacaagtggcaaaaataaaccttccatttgtttacctcttttattgtttgataagcatgattatatcaaattctggacaagaaagcaaagttcgaccaaacagaaaaagaccgaactttcgttcagtcttcgcacactattttgcgctccatacactctcaaggatgttggtctgttcacgaccaggtcctactgagaaggttgagatacgaacgcctaccaattcgctgatacgacgaacatagttgcgagccgcttctggcaattcatccaggctacgtacacctgtgatgtcttcagaccaacctggcatttcttcgtagattggtttgcaacgtttgagttgctccaaacttgctgggtagtggtcaatacgctcaccatccaagtcataagccacgcagattttcaaggtcccaagacctgacaagacgtcaatcgagttgagggacaagttggtaatacctgacacacggcggctatggcgcatcaccactgagtcaaaccaaccgacacggcgtggacggccagttgtcgtaccgtactctttaccgatttcgcggatacggtctccgatttcatcgtgcaattcagtcggaaatggtccgtcaccaacacggctagtgtaggccttacatacaccaacaaccttgtcaatcttgcttgggccgacaccgctaccgatcgtcacaccaccagcaactgggtttgaagaagtaacgaatggataggtaccttggtcaatatccaacataactccttgcgcaccttcaaacaagacacgcttgccttggtcgagggcatcgttcaaaataacagatgtgtctgttacatactttttgatttcttgaccgtaagcatagtattcttcaaagatttcgtcaaactcaatcggagttgactcatacatcttctcaaacaagcggtttttctcagccaagtttgttctcaaacgctccgcaaaaatctccttgtccaagaggtctgcaatacggataccaacacgcgcagccttgtccatgtaggctggaccgatacccttgttggttgtaccaatcttattctcacctttagactcttcttgcaactggtccaatttgatgtgataaggcaagatgacatgtgcgcggtctgaaatccgcaaattatctgttgtcacacctgaatcatggagatagttgatttccttcaccaaagattttggattgacaaccacaccattaccgattacagaaatcttttctgggaagaagattcctgacggaatcaagtgcaatttatacttcgtgccatcgataacgatagtgtgtccagcgttatcaccaccttgataacgtgcgattacttcagcattagcagacaagaagtctgtaattttacccttaccttcgtcgccccactgggttcctacaacaactactgatgtcatattcactctttctctgaactggctaaccagcccagcctttcttctacttctggcaggaatctcacctgcaagtttcgttttacacactattctatcaaaaaacgaacattttttcaagaaattccaataatttcatatatatcgaatgtttttatttttttaaaagtatattttaaaaaaatccgattaaacacacgaggtagacatgtgtaaatatgcttttggcagagaaatccgaagtctttgtttactttcagtgattttcagtacatttttcaccagaaacgtagcagaaatttgtatttgctctccaatctagataaaattggaataagactttgacagaaatataaaggacttagatatgttacaaaaattatcaccaaacagccccattcttcaggctacttttggaattgagcgcgaatcacttcgcatcaattcaaaccacagagttgcacaaactccccatcctcataaactgggttctcgtagcttccacccctatatccagacagactacagcgagccacagttagagttgattacaccaatcgctcagtcgactaaggaagcgcgtcgcctactgggagccattacagatgttgccgcacgttctatggataagcaagaatacctctggcccctatccatgccacctgtgatttcagaagaggaaatccaaattgctcaactagacagcgactatgagtaccaatatcgtgtcggtttgggggaacgctatggcaagctcgtccagtctatgtctggcatccattataattttgaattaggaaaagacttaacccaacaactttttgaattaagcgaggaaacagattttatcgcattcaaaaataccctctacctcaaattagcacaaaacttcctcaactatcgttggctcttaacctacctatatggagcaagtagcctagccgaaaaaggattcctaaccacggaagtcggttgcgtccgttccattcgtaattccaagtacggctatgtcaactccgatgatgttcatatttccttttcttctctccaacagtacgtggccgacatcgaacaagctgtccaatctggtcaactatccgctgagaaggaattttactcttctgtccgactacgtggagcaaagactagccgtgactacctcagcaaggggatttcttatttagaattccgttccttcgacctgaacccctatgacccgcttgctattagtcaagaaacccttgatacagtccacctctttatcttatctcttctttggttagaccaactgacagatgttgataacaccttagcaaaagcagataaacttaacaatctcatcgccctcagtcacccacacacacctctacctaacgatgccgatgccacgccaatcttgacggccatgaaagccatagttctacactttggactggatgactactatggccaactcattgcacatgcggaggcagcacttcaagaccctcgtttgaccctttccggaaaaatagcagagcaagttgaagatgggtctctagagaagttcggtcagcagcagggacaagtctttcatgactatgcttggacagccccttacgccctcaagggctatgaaaacatggaactctccacccagatgattctctttgacgccattcagttgggcttgaatgtggagattttagatgaagaagaccagtttctcaaactctggcatggtaaccatgtcgagtacatcaaaaatggcaacatgacttcgaaggacaattacgtcattcctctagccatggccaacaaggtcgtgaccaagaagattttggaccaggctggttttccagtacctgcgggagctgaatttgcaaacaagacagatgccctgcggtattacggacaggtagccagctctgctattgttatcaaaccaaaatctaccaacttcggccttggcatctctatcttccaggagccagccagccttgcggactatgaaaaagccctggacatcgccttttcggaagatagccatgtgcttgtggaggaattcgtggcgggaaccgagtaccgtttcttcatccttgatggcaagtgcgaggctgtcctgctccgcgtcgcagccaatgtcgtgggggacggtagctcaaccatccgtgaattagtagagcaaaaaaaccaagatccactgcgagggcgtgaccaccgttcaccgctggagatcattaacttgggcgacatcgaactgcttatgttagaacagcagggctacacacccgatacagttttgccagagggcattcaagcctttctgcgtggcaattccaatatctcaacgggtggtgactccatcgatatgaccgaccagatggacgagtcctacaagcaactggccgccgatatggcaactgctatgggagcttgggcctgcggtgtggacttgattatccccgaccgcaccaagccagcaagcaagaacaagcccaactgcacctgcatcgaactcaactttaaccctgccatgtacctgcacacctatacttacgcaggacctggtcagagcattacgccgaagattttgaaaaaattatttccagagctatagttttccattttccttactttgttagtgcttacttcaaaggttcgtggaacttttgaaggctggggatagggcaaagcacgttcgcctcaatagctgcaggttgctgggagtgagaaagaactcgaccaagataaaaagagttcgtcaacaagttttcgttttaagttgttgagctgaaacagtctatccccagactgtttcactcccacccccgcacagctcaaactgtctgggagacagtttgaggttggagataaggcgaactctgttcgcatcagtcgtagaggccagatttggagtgtgaaactcgaattgctgagatttgcttcgcaaatcctatctccaacctttaacagtccactggactgttaaacccaatcaaccactgcgctgagatgttgacacgaactctgagtagtggtcctgggctttttgcccagcctcagttggaaataagacttgcctctctataaagtacggcaaagcgagttcaaacaaaccagtggattgtttgaagcgggaaatccagaaacggagttcctcttgcgccgaagtaaaaaaagtcaacaaaaggactatatatctgctttgcccttttgttccttcacaaaaactcccaactaatgttaaacaaaatgaatatggcaccaagaaaatcatttatatctcggtgctttttttgtgaaccaattcccatcacccaaccgatttgttcgttttttgtttcgttttccaatttatttttaccatttcatttgaatttttaaaaatatccgtattatatctaaaaaagtattccaaacgactcattttctgttaaactatatgtatataacaactgcagacgtttttatgacgtccatatataacaaaaaggagttttatatgaagattagaaaccgttctctcttctataccgtaggttctgtagcggtaacagccggactcttgcttagtcttgctacttcgcccataccatctgtgcacgctactgaagtggcgatagagaattatccgtcacttgcaataaccaagtcggaagtcacgatacaaggctatcttattgcaccacttaatagtagcggaactgcttttgacgccactaacaaaacaaatctagcccttggtgcaagcatggatactgcggcagccgacactatccctattcaactaaaagaacctcttcgtagccaattcaacctcgttaatcatcccgaactagtcggaaaattggttcgcatcacaggaactagcgatacatacatgaagcgagctgggatcaaaccagctacagcgattgaaatcgtagattcatcttctactaatgttcagccaccaacaagtgaaaatacagctaccaaaccaagtgaccttgtttctacaccgattgctactgttcgttccggagcacaaggaacagagtacacagtttctggtaaaattattagcctagtaaacggttggggaggaaatggtttttacctccagggttctgacggtgctggtatctatatctacccaggggctgccttgggctatcagcttggtgatacagtccaattaacaggaacattgggtgagtataaaggcgaactccaactaaccacagttagcaaccacaaggctatctctgagaatttcaacactcctattacagaaacaaacatcgctcagttagcaacgcaagcacaggcaacactagtttctctaaaaaacttgactgtcggagatattcaaagcgatagctatcaaaattctacctttaccgtaactgactccgaaggacaaactgttgatgtacgcttagatagccgaacaggcatcaaaacggcggatcttttgaaccggatcaacaagggagataagattaatctaaccgctattttatccacctataacggaaaaatacaattaaaaccatttgacctctctcattttgaagtcattgaaaaggcaacgacggaagcaggactaggaaagaccgaagctgtaacagtcggtcgcattcaaggtgcaagtcaccagtcacctctggtgaatcaatctgttatgcttaaaaatgtcgtagtaacctacgttacctctgccaataacttctacgtgcaagatgtcacaccagatggagacaccaaaacatctgacggcattaacatctttactgacaaattaaaaacaaatgtcaaggtaggagatcttgtcactatcgcaggacgagtagaagaataccagggcagagggtatgctgaacgtgacaaaacagacttaaccatcacacaaattcgagctactgaagtaactgtggatgggactgcacctgtaccatctcctatagtcctcggtcttgatcggactatcccagcagatattattgacaacgacggtttggctcaatttgatccagaacaagatgcgctcgatttctgggaatccgttgaaggcatggtggttgccgtggatgatgcaaaaatccttggcccactaaaaaacaaggaaatctatgtcactcctgccactagtcaacttcctttaaataatgttggaggcgtcaaccttcgccctgaagggaataataccaatatcattccacttcttttgaaaaatggaaaacaaatcgtcaaatcaggagactatttcatcggtcgtatcgctggaccagtcacctactcttacaccaattataaagtctatgtagatgatagcacccttccaacattgcacgaaggagctacaaaaccagaaacaacaaccattatcccaaatgatgacaagctgactatcgcttcttataacattgaaaacttctctgctaatagtaagtcaacatcagacgctaaagtccaacgcattgccaaatcctttgtttcagacctacattctccagatgttatcggattgattgaagtgcaggacaacaacggtgctacaaacgacggcacaactgatgctagtaagagtgctgaacgcctgattgcagccattcaagcagccggcggaccaacctatacctatgtagacattgctcctgaaaacaacaaagacggcggacaagagggaggcaatattcgcgtcggcttcctctacaactcaaaacgtgtcagcctatctgacaaaccaatcggtaccgcaacacaggcagttgcatgggaaaacggcgaactcaatctcagcctaggccgaatcgacccaaccaaccctgcttgggcagctgtccgcaaaacacttgcagctgaattcgtcttcaaaggcgagaaagtcgttgtccttgccaaccatctcaactcaaaacgcggtgacaatggtctctacggaaaaatccaacctgtcagcttcaagtccgaagaaaaacgccacatactagcacaaactatcgctgactttacaaaagcaggcttagctcaaaatccaaatgctaatatcgttatgctaggcgacttcaatgactatgaatttactaaaaccatagaaattttagaagcaggaggaatggctaacctcgttagtcgtcacgatgcatccgatcgcttctcttacttctataacggaaataatcagtctcttgacaatatgctagtatcaactaacttgttggagcgctatgcctttgatatggtccatgtcaattcagcctttatggaagaacatggcagagcttctgaccacgatccactattggtacaactggatgtgacaaaggcacaagaaccaactcaaccagaaccaagcgacaagcagacagatgactcaggaacagtcaataatagtgatgacaatggtacgaccaacaataacaagccaacaaatctttcaacttctaatcaaacagctgtaaatgctgatgaccgttctggcgctacagacaagagacaaacaaccgtgacccctactgccaacaacagtcaaaagaaaatccttccaaagacaggaggagaaacaagctttgtacttatcacaatcggtctcgtattcttgagcgcctgtcttgtcaaaaaacaaaaagaatcctaatcattttttgagcttgaaagcatgactttcaggctcatttttctactgctccacctccacttgtgctataattaaagttatggataaaattattaaaacactatcaaaaagtgggcatttccgtgcatttgtgctagatagcacagaaaccgtgaaaacagcccaagaaaaacacgacaccatggcgtcgtccaccgttgctctaggtcgcaccctcattgccaatcagattttggctgtcaatgaaaaaggcgacaccaaaatcaccctgaaaatcttggccagcggtgctgttggggctatcatctccgttgccaataccaaaggtcaggtcaagggctacattcaaaatcctgacttggactacaaacggacagcgactggcgaagtcatcgttgggccccttgtagggaacggacaattcctggttatcacagactacggaacaggtcatccttacaactccatgacacccttgatttctggtgaaatcggtgaggactttgcttatttcctgacagacagccaacagacaccatctgcggtgggactgaacgtgttgttggacgaagaagacaaggtcaaggtagctggcggcttcttgctccaagttttacctggagcgaccgaggttgaaattgcccgtttcgagaaacgcatccaagaaatgcctgccatttcaagcttgctggcttctgaaaaccacatagaagctctgctatccgccatttatggcgacgacgacttcaaacgcctgtcagaagaggaaatcggctttgtctgcgactgctctaaagaccgcttcctcgatgctctagccagcctaccaaaagcggacctgcaagagatgaaagaagaagacaagggcgtggacatcacctgtcaattctgccagacccattaccactttgacgaaaacgatttggaggaactcatcaatggctaatctcaatacccctttcatgattggtgatgtggaaatccccaatcgctgcgtgctggccccaatggccggcgtgaccaactcggccttccgcaccattgccaaggaaatgggagcgggactggtcgttatggaaatgatttctgaaaaaggccttctctacaacaacgagaaaaccctccacatgctccatatcgacgacaacgaataccctatgtctatccagcttttcggcggcgacgccgaaggactgaaacgggctgccgacttcatccagaagaacaccaaggctaatatcgtagatatcaacatgggttgccctgtcaacaaggttattaaaaacgaagctggtgccaagtggctcaaggatcccgacaagatctaccacatcatcaaggaagtaacctcggtcctcgatattcccctgaccgttaagatgcggaccggttggaacaataccgacctggcggtcgaaaatgccctggccgcagaaagtggcggtgtagctgccctggccatgcacggacggacccgcgagcagatgtacacaggaacagttgacctagagaccttgaccaaggtagctggcagcctgaccaagattcccttcatcgcaaacggcgacatccgcaatgtagaagatgcccgccagcgaatcgaggaagtcggtgccgacgctgtcatggtcggacggactgctatgggaaatccatacatcttcaaccaaatcaatcactatcttgaaacaggagaagtcctacccgacctctcctttgacgacaaactcaatgtcgccttcgaccacctgacccgattgaccaatcttaagggtgagtccattgccgtacgtgaattccgtggtcttgcccctcactacctccgtggttcagcaggcgctgccaaaatccgtggtgctgttgcccgagcagagactatcgagcaggtccaagaactctttgaccaagcacgagaagcctatcaggaacggattgctaaataatatagtcgaatgaattaactttgatacatcgtcactttcggcttgccgtactctagtacagcctgcacctcagttccttgtctgaaagctaattcattcgactatatcaaaacctccagtttgagctggaggtttctttatctttttatgaactttcttttaagcgataggtctttctgggtttgcgtttgggcaatcgttccactccaacttcttccacaaagtctccatacttggctaggaaattattgtggaggatttttttgtcgggtgagataagattgaccaagtctgtcgcagcgtagatgttaaagggctgctgcaggagattgagaaaggttggattccacttcatccgtccctgaatccgctggatagaggtcatgacaatctcgtaatggtcaaaggcaaaatcctctgccgtcaagacctgaccctcataagaacactgcgaagtcttgaaatccacatcgataacaatcggctcccgtccatctggacctggtttgaccaaatccaaggcctgactaggcaggtaaaccaagtgggcaatagtcatcatccagccccgcggatcccgctcagaatcggaaaccgttaggagttgctcgatatgattgcggggcaaatccagtcccgcttctttttttatctcacgctgacaggtctggtaggcatcctcacctctggcaataaagccaccgaccaaggacagcttgtgttgacaagggtgggcagcacgacgaatcagcaagagcttgattctcccctctacaaaactatagaccaccatatcagctgtcacgcttggtttttcaaatcgcggagcgtcctgctttttataccagtctaaaaattctgcctctgtcacatatttttcgtagtattccttgtctgatagaccagcaggcctagccatttcgagccacctgcccttcttttatggacttagaccattggtaccagccgacaagcgagttgatagtccaaacgaagtacataaccgacatttgcaggttaccactatctggaccaacccaccacaagtaaatggagaagacattggttgcaatccagaaaatccattgctcacggtagaggtaactttgcaggaattgtcctgtccagttggtgccatctgtaatagagtcacggaagggacgagctgatccaattgacttgtaaatcaagccaaaacttccccataccaagacagcgaagactaaccacttaacccagccccagagagtcagcttacgggcttcaaattctgttttctcttcttctgctgctccattgacacgggctgatagccagaaatacaagccaactggctgcatgacaatgaagaaaatcgctgtcatgacttccccatagaacatattttggtaagataagacaaaatagatgaggttactgataaagccaaagaaatagttacttgaccgtccttctgctaccaagataacacagataatccctgtccacgaggtaaacaagcccatccagtcctcactagcagaccatacatgtaagataacaggcacactagacaaaactagcaagtagagccactgacctagggtacgaccgaaaaatagtcccgcaatgattgcgtccagaactccgataactcccagttttttggctctatttgcgatagcagacatgttttctggtacctgcttcaaggaagcttgaaaacggtcgatgaatttggtaagttgttccataatgtcctcctaaaattcctgatagatagcatcgattagctcgatagccttggcataattttctgcataagacccaccgataaaggccagcgaagcctgcgggtgatttttagcaaccagttctttcaaatgttcggtaaaggcattgcgaatttctgcgtcagccattgtcatatcccgaaaaccgtcatccacataagagcctgtcggtagaacaaagataatcaggtcccatttttcattcttaaccgtatcagcacagagcgagtggaaagaactagaagtttcgccgatgtagtagtcgtagtaggcttccgtcacggtcgcgttggtgtccgcaatgaccagaccacgattggtatccgagtcaatcaggtctgaggtctggcgatactggcccgtcaagagatagttgtagtccttgcctgtcaactcatcatcacgcacattgtaacgttgctggtagtagcgggcatattccagcgaaacaggacaggaataataacgccccaaatcccgcactagcgtggttttaccatttgaagcagagccaaccaccaagatattcttagaaaaatgacggcggaaaggcttggcaatcatattccaatacttagccgactgctcgcggataagagtggctgaaatgccaaaatttcgctctgtaaaggaagccttgaaaccacgagaacgcaactcttcggcatattcctgctccgaaacgtagaagacgagctcttcgttctccttaatcgccaccaaggcctgcaaggcttctaaccaaggtgcccaaccttctggataagggggcattccctcctcgtctagcttaaagacggataccagaggctcgtcgttgaaggtttcgcggatatagcggaaacgtttctgcaaaccgagaccaatctgatgaccacggtcatttttatagcccgacacgatgacgaccgcccgatcgcattcccgcttggctcgttgaatcaggtcaatatgacccttgtgcatgggagcaaaggtcccaaaaataactgctactgcttgtttcataatctacctttttattgttttttatattttatatcctactcttttctcaaaccaaagtcaagagttttttatatttttttataaaaagatagcaagccgaaagaaaagcaggtctaacctgctttcacactatcaaacttcaactgctcggccttgacccctacttttaaggtcacaccagctggcagttctccacgtaagagcatttctgccaatggatcttccaacttggtttggaggaggcgacgaagtgggcgggcacccatttctggatcgtagccttctttggccaagagtttaagagcagaagcctgcaatttgagggtaatacccttgctggccgccacggcaatcaatggtttgaccatgaccttgaccacatcctgcatatctgcttctgtcaggctatggaagaccactttttcatcaatccggttaataaattcaggacgataggccttcttcaacgcctcaaaaatccgtttttcaacgtgttcctgactcttagacaaatcaagagccccaaacccaactgtcttatcatcacgtaaagcggttgcccctaagttagacgtcataatgatgaccgtattagagaaatcaaccttgcgaccttttctgtccgtcaagacaccgtcatccaagacctgcaaaagaacattgaaaatatctggatgtgctttctccacctcatcaaaaagtaggacagagtatggcttgttgcgaactttttctgtcagctcgcccccttcttcatagccaacatagcctggaggagcaccgttgaggcgactagccgcaaatttctccatatactcactcatatcaaaacgaatcaaggcagattcgtcatcaaagaggatctccgccaaggccttggccaattctgtcttaccgacacctgttggccccaagaacataaaggaaccaatcggtctgtgaccagtgcgaatgcctgactggttgcggcgaattgcccggctgacagctgaaatcgcctcttcctgcccgataacacgcttgtgcaattcctgttcaagattaaggtacttcttggcatctgtctgactcagtttggtgacaggaatacctgacaagcgactgagggttgccaaaatgtcttcttctgtgacttccaagctatagctagtcgcctgattttccgcctcttgagccttaagcaagagctgcgttaccgtcttgtatttcccagccatcaaggcttggtctaaagcggtcaatccaccttcttctacctgtcccttggcacgattttgaaccgtcgcactggcttcatccagcaaatcaatagccgaatctggcaaattcttactggtcagatagcgtttggcataggctaccgccgttaccaccgcctgatccgaaatggtcaccttgtggtgagcctcataggctggcttcaacccctgcaaaattgctacgctgtctgctacactcggttcctcaatggtcaccttggcaaatcgacgtactaaggcagcatctttttcaatatgcttctggtattcatcctgagtcgttgctccaactgtccgcaaagtcccacgggacagagcaggcttcaaaatattggcagcatccaggatcgagtcaatccctgaccccgatcccataatggtatggagttcatcaatgaagagaatcactcgaccatcttcttcaatatcgttgatgatattgttcatccgctcctcaaaatccccacggaaacgcgttcccgcaatgacattcatcaagtccaattccaagatccgcatattgacaagactagctggcacctctccattagcaatccgctgggctagacccagtgccagagctgttttcccaacacccgcatctccaaccaagacaggattgttcttggttttccgcgacaaaatctgaagcatacgggaaatttcctcatcccgtccgatgactggctccaactgacctgagcgggccaaagccgtcaaatcacgtgtatagtcttccaagccaccactttgtgactgggtcatgcccatcatattgccaaccgttgcctgcttgggcttgccacctttcgtcatggtgcggatagccttcagatgctccttggtaaagccagccttggcttccagatttttccgcaaatccagaaaacgaaccttatcatccgaatcctcaaagtgaaaaccgacctgatccagaatttgtgaggcagtcgaacgcttgtccaagagcattcccatgaaaatatgctccgttcctagccccttactcttgacaatctccgcaatcttctcggcaaagacctgcaattccttcacccgcttggacgatggaagaaagaaaaagctctctaactcttcatggtaacgccgccccatcaccatataaactgcacgttcatagtccaatacatccgcaggatattctgctaaaatagctcccgcaacggtatctggattgatgacaaaggctaacaacaagtgccaggtctccaaatagtcactactataacgctgtgcaatcaattgagcatcttcatagacaccctgtaaccctcttgaaatcttcattctaactactcctctttcctatccaatcgacgtaaaatttggtacatcatccgagcccgaatttcactagcctcgttccctaaaacctcatctgtactagtagccaacaagagattgccctcacgttccgtcatcaactgctcgtcaaagagcaactgcagaatgtccgcaaaaacagttgccgacaggctatcacccatattcttcagcaaatcatggactagctcatgcttgtccgaaaaggtaatccgcccaatgcgaatgtagccaccacccccccgcttgctctcgacaatataacctcgactggctgtaaaacgagttttgataacatagttaatctggctgggcaccacttcaaatcgactggccagctcgctccgacgcaactcggctacactgacctgatctaaaatcgctttgatatgttcttcgatataatccgacgtatttttcatcgccatactatcgcctctttctttgactatctttgaccattatactatttttatccactttttgaaagcgaaagcctcacttccacacaaacgtagccaatttttgaaatttgctctgctttcttctataataaaggaaaaaaaaggagaaccccatgaactttcaagactacatccaagattttaccagcgtaaacgtggagcaggcacagagccttctaactgccaatgagggagcggtcctcttcatcggccgtgcaacctgcccttactgcaaccgcttcgcaccaaaactccacaaggttgcccaagacaagcaagtgaccatccacttccttgactccagccaagtcagccctgaactccaggccctccgcgaccactaccaagtcccaactgttccaggcctcctggtcgctaaatctactggtgtccaagtccgctgcgattccagcatgacggaagatgagattgcggcttttattcaagactaatgctagacatttcctaccaagccaacaccttccacatctcttatcaaggaagaccactcggcaagattcacagcaaccaaaatccctaccaccagaccaatatctatctgcgactagatttggttgatttcgattgcaaaatagcaaagcagctcttccagtccctacagacttccttaggcggaaaacctcttcaagttatgctctcctctgcagagcaggaaagaatccatttccttaccacagctggctttgtctgcaagcggaaatgttatgagttcgaagtgaccaagcaagactatctcagtcaaacaggcacttccaacttaagcatagtcctcaaaggcaccgcaccttatcaaatagtctgtcagcaaatttttgaccactatcaaacagtccaccaagacatcaatccttggactgccagtcaagaagaatttgaaaaaggcttacctgatctggtttatacagactcagaaaattgtgccttcatagataccgatgaaattgcctacgtatgcggaaaagatgaacaaagctttggttccttcatccaagcagttatttgccaactatttgaacagtatgagcaaattagctttgaggctgatgactgcgatcctatcgccatgcatttagctgaccaattccgacaaccaaacaagcctagctgggatgcttacattttagaaatctaacaaaaagcaccgaccacaaggccggtgctttttaaggagattatgaaaaatatttaggattgataatagtataaccgaatcaagcatatccgacatccgccctaagaccgattttgccaaaaaagaactccctttcggaagttcttgtgattttgaatagtctatcagtttgcttttagtactaggaaacgagccgcaggctgtactgaagtacggcaaggcgagttaacgaagtaatgaaagataaaatgaagactagcaattatttaccaagagctgctgccattgtcgctgcaacttctgcttcaaagtcgtttgaagctttctcgataccttcacccacttcgaaacgagcaaattctacaactgaagcgttcactgagttcaagtaagcttcaactgttttgctgtcgtccatgatgtacacttgtgcaagaagtgtgtaagcttggtcaacttgagtgttgtcaagcaagaagcgatccattttacctgggatgattttatcccagattttttctggtttgccttctgctgctaattctgctttgatagcttcttcagctgctgcaatcacttcatcagtcaattgagcttttgaaccgtatttcaacaatggcaatactggtttgttaaccattgcacggctttcgttgtcttgttcgatcttgtggttgatttgtgccaactcatctttaacgaattgctcatccaattcagtgtaagaaagaacagttggtttcatcgcagcgatgtgcattgagatttgttttgcaagagtttcgtcaccaccatcaacaactgagataacaccgatacggccgccgttatgttggtaagcaccaaatgcttgagcatctgttttttcaaccaaagcaaagcgacggaatgagattttctcaccgattgttgcagttgcgtttacgtatgcttcttcaagggtttcacctgaaggcatagccaatttaagagctgcttcgttgtcagctggtttaccttctgcaattactttagcagtagtgtttaccaattcaacgaattgagcatttttcgcaacgaagtctgtttcagcgttcacttcaacaactgctgctacgttaccatcaacgtaaacacctgtcaaaccttcagctgctacacggtcagctttcttagctgccttagccatacctttttcgcgaagcaattcgatcgctttttcgatatcaccgtcagtttcaaccaatgcttttttcgcgtccataacgccagcacctgatttttcacgcaattctttaacgagagctgctgtaatttctgccatgtctattctccttgtttgtatttataaaatagaggagcgggctcagccctgcccctctaggattgtttttgtgtctgataaataatgtagaatgtactcggactaaaaagctagaatttagatatatctaacgcttttcttaacgccttcgttacttattttccttctacaacttcaaccaattcttcgattgattctgtagatgctggctcagctgccaattcagcttcaactgctgctacactgtcttcaccttggttgccttcgatgatagcgtcagccattttagctgtaatcaatttaacagcgcggatagcgtcatcgttagctgggatgataacatcgatatcatctggatctgtgtttgtgtcaaccatcgctacaactgggatacccaatttcttagcttctttaacagcgatttgctctttgtgtggatcaacgacgaacattacatctggaatgcgtggcatgtcagcgataccgcccaagaatttttcaagacgagcacgttgtttgttcaacaatgctacttctttcttaggaagcacttcgaaagttccatcttcttccatacggttgatttctttcaaacgagcgatacgtttttggattgtaccccagtttgtaagagttccacccaaccaacggtggttgatgaagtattgaccagcgcggatagcttcgtctttaacagcttcagcagcttgttttttagtacctacgaacaagataactgcgtcgtttgctgcagcgtcacggatgaattcgtaagcttggtcagccaattttacagtttgttgcaagtcgataacgtggataccgttacgctctgtgaagatgtacttagccatcttaggattccagcgacgagtttggtgaccgaagtgtacaccagcctcaagaagttgtttcattgaaattactgccatgagtatttctccttttgttttttctcctctcccgaacttcgacttgcagcccaacctttcggcaacaagaccacaattggtccgggatgagtatttgttgtttagacaacttagtaagtataccaaagttttaggtgaaaatcaagcatttcagtacacaaatctctagattatgccaagctcatagatcgggatatgtctctctttatgttactacttttttattatttttaacttcatccattttactttctatttcttagaaatagaaaggaagtaacgcctatctggtgttacttcctcttagttgtatcccttagataaactgtgatacaatgtctctctatcataaatcaatctctatctcgtaactctcatcaatccataggatgtttgcatcatattttttcgcccttctaaaaaatcgagtattttcttctaaaacactttccatcgtacaccattcatcatctatacgattttctataaggcgtgcatgtttctttatgcttccaaagtgtttctgaatatagttttcactcatcacaagacagtaatatctgatatggtcaaggtaggctgttgcaaagtcgtttgcccaatcaaaagggatatagatcccttcaacaataaggttttgctcattttctatagcagttttaatcatttcacgaacaataggccatagatatgctgtaagtttatcatcttcttcgactgaaagtttagtattgccgctacgaattaaccccattttcaaatggtctattgataaataaggatagtgatatttttcaagtaatttttgagctagcacagtcttcccagtgtgagatgctcctgttattaaaacaatcatgattttctcctatctaagcgacaaagcatctatgttttatatgaaaatttgtaagaaacactgcttgtcatcctatctattttttaatctcttactcaatttattatatcatgttcccacattttttcagttaatctaatcaagtacctgagttatctttgcaatatactgtaaataaaaacaaccgttttagatggaatattcttcttggtttaatctttatttagcaaaaataaactctatcacctccaaatctttcttaaagaggtgcactattatcgtaattctgttcccttaacattccttgcagtaaaaatgaattcacttacccaaagtgtttcttaattctttttgctccactctttttctatcaaacaaagagagtggtactagccatcaatactcaaaaagtactcctatctttttcgtcgtattctcctatgttttcgcaactgttttatagatttgttatcagtcacaaacagtcactagatttttcttgactttcagcttttttttcggtagaatattctttgttatggcggtatagccaagtggtaaggcacggctctgcaaaagcttgatcgtcggttcaaatccgtctaccgccttttaatattctaaaaaacctaggaatcttcctaggttttttactattcttttcgcttcaaatttccgagggccatagctccaccaaatagacctaacaaagtacttataaagacacttcccaggctatccccagtttgaggcagtttcccactagtatccgccgctaatgcacctgtctctcctattccgcttctttcaaagaattctctgtgaggtacggacacttctattctctcgtcagaaattcctagtggctcctcatgttttgtaagtttccccaaatgctccacaccatcttctcttgtatcgccagttaacagcgcgatttcagtggatcctgtttgcggagcaagtgaattctcttcttttggcattggtatatgcgcttccgatttcagaataggaatgctaggggtttgatccttatctgatcgctccacatgaaggtctttttcaggaacctgctcagatacttccttgtcatttaaccgtaccttatatttcttcacaacagcatttccaaaactgtcactcaaatcaagtttgactgtatccccgtctttcagactatgtagctcatagcgaaaggctttttcattatttccatactgcctccagaagcctcctcgagctacaaaatcttcgttgatcttcaaggaccaataaattccattatccttggcgcttccggtaagtgtcaagtgcccatcagcatctgccaggaggactcctgcatactgattttcctcgtcttcatcttcttcactatccactacctgtctttccaatggtagcacctcattttccagctgtaaaacagggttttctgtatcaaccaacatctgatatttcttcgtgtaagtcaactcatctgcctcattgtacacacttatatccacaacatttccctcttcaatcagagtaactggataggtcaacttcccatcctcaaaatagcgtttttcaccaccattgatgcgcacagaatgagcttgttcggtttctgcttctatttcaaatgtaaatagataagtcccatcttcttgctttttgaagtcgaccaacccgctatctagctcacgaccaagactttctttattgaaacgaattgggtcaatcagccagttattgacagtaatcggaacttctgtttcctcctcctcatccagactctctggacttgtattgatacgaaggtcctttaatttatttcccttctcatctaccgcagttaacatgatggctctaggaaaatcagatttaaagaagtcttgctcaaaactgccgtcttcttttacatctatgattttccgctctcccttaccaatgtctagattggaatagtaaagtttgatgtccttaggaagactaacattatcactcactttccctttcaatgtaaaacgcccatttttaccaatctggataacctcttcatcctcttcatctttttcaatatcaagatcaatcgtcggcttttcattatctaccaaataattcaaggttttagtgtaaataaggttgccatccttatctttcaagattaattcaaaactatgacgtccatctgattgctctggaatctggagagatagttgaccattctcaagagagtaattcacagcctgagcatccaagttagcctgtacatcggaaacttgcgctgagacgttcgctttaatttctacagttttcttactgcgaattgccatcaaatcttccaaatttttaaactggattacaggcgccatcaaatctttttcaacagcaaccacattacccgctatatccatcacctcaacacggagatgatttttagcatcgagtggcagttccacttctttgagatggtaatgtagttgacctgcatcatctacaaccttttcaacaagaagatcttctccatttagattagctcgaacctcccaaactttattattatccttggctgtgacgaccagttctctatggctggatagacgattggtatcaatcgcgacaatctctggcttttgattatcaattttgactggcagataggtatactgataggccccattttctttattttttacccgcaatctaaagaaatattgtccttccggtgctggtatattttcatcattgcttgcatcgtacactttcccatcccaacggtgcaattctatcggagtacgaagcttggaatactccgatagactttcaaaataatctacatagcgaacacgagacagcatggttcctgtatcaattcgccttaaaacaggagcatcttctgtagcttcttttacaatatccaaatcatagttggtaatatccctcaatagcgcaaatcgaacaaaggcattcccaatctgactgtccgaatgctggttttgaattgcgatattgtctggattgagaggcgattgattatcttgaatcttttcacgcccaagttcaatatagcgcccagacttattgtgtttatagctagataaaactgaggtcagtttcaatttagaactggtttcccaagccggtgcatcaacaatcctttcttttgaccagtcaccaacaaagccaaaataaggtatgctgatgtcagactgcccctccgtcaatgatttgaagtaaatatacccttctgcaaactggtctttcgcttctcctgcatccaatttcaggcgaatggttctcttctcttttggacctagttgaatggattgctcagaaagatgaatactcgaccccttgatttctgtcgcatgaatctctttaactacttttccagaacgtcctattctatcaacaggaacatcttgactagtcaacactttcccagctgaaatagcaaagcttctttgttggtttcccagattttccaaggttacctcaaattctgtctcacgccctatttcttttaattccacccctccttttagacggtggtgaagaatcacatctgtttcaaaggctctatcaatctgcaacagaccagcaccttgttgtctcggagaattttccaaagcatgcccagatgaatctagaacatcaaccaaaggggtagcagtattcatcaaaatgattctcagcaaatccatcctagtcatgccttctggtggtgtcatttggcgaatccgtggcaataaaagtgcgctggcacccgccacaattggcgaagccatcgaagtccctgacatggagccataacgattgtcattcaaggttgcataaacatcctctcccggcgccacaatctctggcttcaattctaagttgaccgtaggtccccaactagaaaagcctgatacagtcggcacttcaatcaacttcttcattccaattgtaggtttaagaaccaaaccagtgttgccttgcgattggttggcaacttctaataatcgccttccatcttccccgctaagactaattccccagatagaggagtaggaaagcaaagtcttatcatctaccaacaactgatgggtcctataataatccttgttccatccctgatcagtatttatcacaataattccagcaacatccttgaatttcaaattacgaacagcatctttcaagtcaaacttatcttttttgataaccgctactttaccagccaaatcaagcccttgcacttcttcccaatgaccatttccagcatctacaaattcatattttccctctgtaagcgttgtatagccaataggatagtaaccaaaagactgtccattcagcataaattctcgttgaacaagatgggtatttctcgccgaaccaaccgcgataactgcgggagtcgctgctacaccaactgttgttgccgtatccacagctcctaaggcattatttgtatgcaggtcaaaggaggtgtctgaagaggaggcaccagcattaccaatagccgctgtaatgataattcccttttctgctgccctcttagcaatcgtgtagtaagcattccctggtagcccgctatcataataaccaacactcaagctgatgacatctgccccgtgtttgatagcatcttcaatagcagcataagcagcatcctccgtctcagctttataatttttagggtcatttgaaaaaatcttgtagactagcagttgtgcgttgggagcaatcccatcaactccctttttagacgcaacttcttcgtctgttgcatttccagccagagttcctgctatgtgcataccatgtggttcgtgggtatcatcgtagagattatcgttgccagatacataattatagccatggggaactttcaatgtgtatgtccctgtcgtagatggagtaatgtccttaattttaggaatgacaccatcatccaacctcatgtctttgtgcttaatatccaaaccggagtcaatgactgcaatcaccattccgcgaccatctgtctgatatttagaacttgcttttaaggcaccaaccagctgtttagcagtatgaagagtcggtcggatacggcgactctcttctaaagaggttaattcggtaattgccttcacatcagacaaactttctttccctacctctactgatgctcccgttaaaacctccttatactcatgaacaattttaacgccatcaattttctttaatttatccaatacaagatttcggttctcttcggaaaattgtaaaatatagcgccctgttgtcacctcttctggctcaagctgtgattcctgcgggattgtttgaggagcactagcttcttttccgctaatgtcttctttttcctttgactcatctgttgtcttaccagctgtagtttctatctcggtcgcagcttgatctgtgagaagacctgattcttcacccgcctctgtatctacaacttcttcgaccactccctcttcagcaactggttcatccacctgctccgttttaactggatcatctgataatggtccatcttcttttttctctaccgcagaattttgcctactatccatatctgttgcgaccgcaactgtagactccaatccttctccactagtatctgcttgaaccatcggaacacccgtgataaaaaatcctattgataccgatgccacaccgacacttaacttcttgatactaaagcgttgtttattctcaatctgagaccacttctgtttcataaaacctccgttttttaagtttaattaatttataagttaggtacacctaattctataaaatttttaaatctttggcaagttttttttgaattagccctcaaaaacaagaaaaagcacaggcttccctgcgctttaacaacttattacaactcagcaatctggcttaaattaacttcagcaatggtatcattaccaaacatagagataaccattttaaccttgttgttgtcgatttctgtaattttacctgtgtagtctgtgaaggcaccgtcgatgatacgaacagtgtcgccaactttgacatcaatatcaaattcttgaacggtttgtcccatagacaccaagatttgacgaatttcttcttccaaaagtggagttggttttgaacggttaccgtgtgaacccacgaaacctgtaacatttggcgtattacgaaccacaaaccaagcttcatcggtcataaccatctcaaccaaaacataaccagggaaacggttttcttccacttccttgacctcaccgttcttttcaacctgaacagtctgagttggaatttctacacggaggatgttttccaacatgttataagtatgggcacgttggagcaagttttccttcactttattttcatatcctgagtaggtctgcaaaacaaaccagcctttatcaaaactatcgtacattgttacttcctttctttggaaacacggaatttttagacgctaaaaaaagcccgaaggctttcgcttttccttattatatcacttccattttacaaatggcaagtattttctagaaaagattgatcaagctcatgattcctcgtgacaaaatcaagtcaaagaggtaaaccaccgctacgaaaaaggcagtatattccactacagacacgaaatccgtccagctctgcttacgagttggccaagacgtatcttttaaaatgcggataatgtctttgataaatttcatgcgtgactcctatctggtttccttgtgaacagtgtattgtccacagtgtttacaaaatttatttacttctaaccgtgttggcttgggattgctcgaaaggctgattgaatagtttcgagaaccacaaacagtacaggctaggcttgctttttttagtgccataaagccctccatccttttcattctaccatgtttttatggatttgacaactctccaaaccaagacgttatgttatcccacaaggtttttgctcgttctggtaactgggcatcgattagattttgtttggtttgctcaatcaagtttttcgcctgttctgaaatttcttgtacctgttcttgaccaaggcttgattcagtttgcgcagcttcatctggagctacttctacaataccattttgtgcataggcgttttctacttcgaacttacttcctgcagtatatggcaagattgaattggccacagtctggaagaccgacggagccttccagtagctactgctatctatataatgattttcatctgtctgctcaaaaccaacccactgactgatgaccaaatcaggtgtgtaggcaatatgccactgatcattgacgagattgacatcaaaactcgtttcggttgttcctgttttcccagcgatatgataattggccgtatctgctgtcactcccgtaccattggtataggtaccaagcatcattgctgtcatcttatctgcgacagcacggtcaatcaccttggtacttgtttctcgatgctctgctaaaacctttccactagccgtttcaatacgagtgatgaggtgggcatccttcatcacacccttattcgcaaaagtagcgtaggcctgggccatttgcagaggattggtctccactccagaaccaattgaaacacccaaaactttctcgacattttccatatcaagtccaaacttttgtccatactcgaaggctttgtcaatacccaaggtgttcactatataagctactggtaaattgtaagagagagccaaagcttgatacattggaatggtatcagaagtcgaataatcatagttatgcaaggtgtaatcgccgtaggtttctgtatggttatccagagccatatcaatcgaccagcccgccgctactgctggagcataggcaacaagaggcttgattgttgaaccaggactgcgcttggcttgtgtcgcaaagttgaaggtccgaaagaccgcatcctctgaactgttaactcgaccaaccaaggcgcgaactccaccagtcctaggatcaagagctacgctggcagcctgagcatgggtaccatcaaaacttgatgttgggaacatagtctcatcattaaaaatcacctgcatgctggcttgagaattttgatccatctctgtgtaaatcctatagccgttattaataatgtctgattctttcagtccgtatcgctcaatcgcctcagcaatcacagcatcaaaataggatggataggaataattgctttgtttccctgtataggtatctgaaagctgactggctaggtctacttggaaacctgcatctgcagtcgcctgatcaatataaccagcattgaccatattttgcaggactgtatcccgacgattaactgcattttctagagaataataaggattataaatctcaggtcccttgagcatacctgctatgacggccgcttgctcaagagtaagattactagctggaataccgaagtacttttggcttgcatcttccactccccagaccccgtttccaaagtaggcattgttgagatacatagtcaaaatttcttgcttgctgtactttttattgatttccagagccaaaaagaattctcgagcctttcgactgatggtctgatcctgagttagaaaggcattttttgccaattgctgggtaatagttgaaccacctccagaccgacctaacgtcaaggcagccaaaattgtacgctggtaattaatgcctgaatttttgtagaagctccgatcttctgtagcgataacggcattctctaaattatcagagatagcatccagctctacataggtccccttctgaccagacaatgtcccagcttccgcaccatctttatcgtaaataatcgttgtggcttttagcgcctgctgtaaatcaccaacattagctgtctttgcaaggaaaaatagatagccacctactgtaagaactgtcaggaccattaaaatgattaaaattttagtcagttgataacggcgccaaaatttacgaatcggctccggaatacgtgattttttctttggtttatcaatagagccacgatttcccctgtggcgacggctaggtcggtcttcatgatcaatttggaaatcttctggaacttcaatcggctgatgttgcaaatcgtccatactttacctctttctagtgaattttgtaccattatacaccatttcctaaaaactagcagaaaaaagcctgcgataacttgtgacaacatacagggaattttttccaaaaatatgataaaatagggtcattctgaacaaagaagaggattcctatgacacaagtatatgacattactatcatcggtggcggaccagtcggtctcttcgccgccttctacgcccatctccgtcaagccaaggtcaaaatcattgactcccttccccaactgggtggccagcctgccattctctatcctgagaaggccattttagacattccagcctttccaagcctgacgggacaggagttgaccgacaacctccttgcccagctggctccatttgacaccaccatctgcctcaatgaaaccctgactgctatcgaacctggggaaaccattaccctaacaaccaacaagggcaaccaccagaccaagaccctgattatcgctatgggtggcggggccttcaagcctcgtccgctggagattgatggtgctgacagctttgacaacgtccattaccacgtgtctaatatccagcagtatgccgacaaggacatcgtcgtcttgggtggtggtgactctgcggtcgactggtccctggcctttgaaaagatcgccaagaccacccagatcatccaccgccgcgataacttccgagcccttgagcacagcgtggaagagctcaagcagtccagcgtgaccattcacacaccttttatccctaaagggctttctggggaaaatggcagagcttctgccattgatttcgataaggtgaagagcgaggacaagctgaccctgtcttttgaccacctctttgtcaactacggtttcaaatcatctgtcggaacgctgaaagaatggggattggaactcaatcgccaccgcattgtcgtcaacagcaagcaagaaacctctgtccctggtatctatgccatcggtgactgttgcttctacgagggcaagattgacctgatcgcgactggactgggcgaagccccaaccgctgttaacaatgccatgaactacctcaatccaaacgaaaaagtgcaacccaagcactcaaccagcctataagatgaaaattgatattcgcattccccaagcctttcctcaactgactgtcaaggaagtcttggaagattattttctcattcccagaaaaattcgccactttctccgcaccaagaaacaggtccgtgtcaacggtgagctgattaactggcagtgcccgattaccgcaggcgacttgttagaattgacctttgaccaggaagattatcctgaaaaaagcattcctctgggacaggcggacttggtggaggaactctatcaagatgagcacctcattatcgtcaacaagcccgaaggcatgaaaacccacggcaatgatccgacagaaattgccctgctcaaccatgtgtctgcctatgtgggacagacttgctatgtggtccacagactcgatatggaaaccagcggagccattctcttcgccaaaaatccctttatcctgcccattctcaatcggctcttggaagacaaggtcatctaccgtgactacctagccctctgccaaggccagctaaaaatgactgactggactattaccgataagattggacgggaccggcatgaccgtagaaagcgagtggtcgacaaccgcaaggggcagacagctcttacccaggtccgcctcttgaagacccttggtaaaaatagtctagtttcctgtcgtctccaaacaggtcgtacacaccaaatccgagttcatttagcccaccacggtcacgctctaatcggcgacccgctttacagtcgagtagctccccctcgcctcatgctccacgcccaaaaactcagcctgacccacccgctgactttagaagaaatcagcgtggaggcgcggtcggagagttttgaaagaatagtaaaaaagagctgaaaaaccagctcttttttgcatgtatgttattcaaaaatatttcccaactcaacatccacgcgattttccttgacattgatgtcggtcacagcgagcagagacttgtagttagctacgctacggtcccctttttggttttctgcaaagacagccacgcctaccaaggttgagtcaaactcagacaagaggctaatcataccattgatggtgccaccatttttcaagaagtcatcgacgattaagacacggcttcctgccttcaaactacgcttagacaggaacatcttttcgatacggtcgctagatcctgacacatagttgacagaaactgttgaaccttctgtgattttcaaatcacgacgcacaatcacaaacggtacattaaggacattggcaacagcattggccaaagggacccccttagtcgcaactgtcatgaccgcatcaatcttctcatctttgaaagcatctgcaatgatacgaccgacatttttcaaaatatgtggtgtagacagcaagtcagatgaatagatataaccgcctggcaagatacgattactttcggccatctgatcacgaagggcctgtgcaatttcgacagactctgccttagagatcgatggagtaaaaacaactcctccactggcaccagtaatggtttcaatatgcccgatagagctttcctcaaaagcctttttaatgatggcaatatcctctgagatagatgacttggcagattcatacttttccgcaaaggtattcaaactagttaattcataagggtggttgatgaggtaattggaaatgacaaccatacgctcacttcttcttaatttcataaaatcatcctctttcacttttttctattatatcacaacaaactacaaaaagcgaacttttttgattgaaaagtccgtctttttcgtattttgtttatcgcttacatataccactttggaagatgatgattaaaatattcataccattcagaaatcttctgcgcttgcaacttcatcaatggaatttgttcggaatctacttgttctgcccaagaaagagcgcctagactatttactgttacataaagagccatgagtttccaaaattcctctggaatagcgccgtcaaaatagacatctacctgaccacgcgcaaaggctggagacaaatctgccgtgaaaatcaaacggttaaattcttcccaggggtctcctatgtcgtagcggtcaaagtctaaaattttcagtcttccatcctggccccgtagaaagttacctgtgtgaaaatctccatgatggtaggcaatcggtctcccttcaagcaagtgacggttggcctgaacaaaggctatcatggcttgaccatttggataggaatgactagctgcttggtaggcagctaatttattgtcaatcttagcctgataaaaactgttccagtcgcgcagactttgatcaatcggtagggcatgcaaggttcgcaaaaacttccctgactgacagcccaattcatataaggtttgttctgacagactggtagccaagtcattcatatcctgaccttccatccattcataaagggtgtagactgacaagtcatccgcccaaaaacttagtggctctgccacaggcaaacctagaccaaacaggttttcaactaactgaaactctaattgcttagcctcataggctggccgctctgctattctcaaaagaccaaggcgaccatcttctagctggaccttgtacttttggtccgtggaccagcctttggtgaggggctgtcgagacactatcctaactgccatcagtcgatattgggcttatagaaggcgcgattatccatggcaaagatgcggttggtcatctcgcctgggccgaccttgtccaaggccgatagcatcatcatcatttccgcatcaatgttgtcaatcatgtggaggatttccgcctccataatctgcggacggacagggcttccatactccaagagcccatggtgactgaggataacgtggcgcagaacagtcacttcctccagactgtcatcgatgcccaattccatcaagaccttggtaatctcttcatcaatcaaggaaatgtgaccaatcagattgccacggacagtgtagccagtattgtctggaccagtcagttcgatcaccttggctaggtcatgaagcatgattcctgcaaagagcaggctcttgttgagctggggatagatgtcaccaattttatctgccaagcgtaccatggtcgctgtatggaaggacaagcctgagtagaaggcatggtgattggtcttggctgctggataggaatagaattccttgtcgtacttgctgtagagagcacggacgatccgctgccaagtggcattttcgatgcggaaaatcatctggctcaaatagtccttggtgtccttgacatccacaggtggtttttccttgaaatcagcagggtcgttgggctcgcctgcctttggcaaacgaagaaccagttgattgacctggggggtgttgttgtaaacctcacggcgcccctgcatgtgaacaacagttccagcagtaaaatccttgattttccctggttgggcatcccagatcttgccttcaatctcaccagtatcatcctggaaggtcagagctaggtagtcttttccagcccgtgtttgtcggacttctgctgacttgattagatagaatccttcgaagaattcatcttttttcatttggttaattttcattatcttcctcatctaatggggacaggccaagcagccccttggtttggtcatcttcgtacaggtcaatggtacgaagactacgctcgatggcgttggtgcgagtggttaggagtttgtcaatattgctgctagcttgattgagctgtttctgggccttgaccaagaggtcagaaaacttgccaaattccagcttgacattgcccaagaccttggaaatatcatcggccgaccgttgaatgttaagggtcttaaagccgacggagagggaattgagcagggcagaaagggtagtgggtcctgctactacgatattttcctgacggcgaagctcatcaaagaaaatgggattgcggaccacttctgaatacagcccttcggttggcaagaacaagacgccaaagttggtggtttcaggcggattgaggtacttgctctgaatgtccttggcaaaacgtttgatagctgccaggagatttttgcgatggaggtcaatctggtccttatccccactttcgtaggcatcttccaagcgataatagtccgccagcggaaacttggaatcgattggcaagtagatatagtctccctcagtccgtcctggtagcttgaccgcatactccacacgctcactagagcctgaaactgtggcaaactctcgctcatattggctaggtgtcaaaatatcctcgataatctgtcccagctgcaattcacccatgatgccacgggttttggtgccagacagcaccttgttaagactacccacatcacgcgccaccgtctgcatttcacccagaccacgattgactgattccaactgcttagacaccatttcaaaggaggcttgtaggcgggtttgcagggttttctccagcttttcctcaaccgtctgccgcatttcttccaggcgtttttcattggactcctgaatggcctgcaaacgaaggtcggtggcatctcgcgtttccaagtggctcttattcagctcttgacggatgtcggttagctgttggtaaagctccgtgcggagtctttccacctcctggtgaatggtctgctgctgtttgagagttgcattttctagttgatagctgagctggtcagacaagttgtctgctgtatcttcggcttgatcttgcaaaagcagggccaagctctgccattttccataaagaaaaaccaaggcaagcaagaccagtatcagcaaaataagtagtacaatatccatctaatccttgtccttactgtagatcaggaccacatagccctgatccagttgaatgtctatatccctatctataaattcgttagaagcatagcattttttgaaaaaataattgctggcatccagcgggtacttggcataacgaatggtcaggtggctttggtccgacggcataaaggaaatgtacttcataccagcaatcggcgaaatcctatgactgcctgcaggtcgaaaacggacgacgttctgactgtccaccaattcaatctgctccatataggctgccaagtcgggttctgcaaccagaaagagattgctcatcatgtggtccatgcgaccacccaaggctccgtatatgcgaacctgggcctgcggataggccttgaagatttcctttaaagccaactccaagtctgtatcatctttttcagcaggagcttgcagaaactgctctgccatctcccttatctgccccagctcctcagaggtcaccgagtcaaaatcaccgatagcccagtcaagaggcagggaatggtccagaagacgaagagagcctgcatctacccccacatagaggtcggcaggctcaggaaggcagtcaaaggaaccgcctgcaataacagcaatcttaatcattgagggcagctctcaatttggcaacgttggcatccaagtctcctttgaagagataggagccagccacaaagacattggcacccgcacttttggctgaatgaatagtcttatcgtcaatcccgccgtccacttcaatatcaaaggccaagcccttggcttcacggagtttgaccaaatctgcaatcttatccgcaacctctggaatgtaggcttgtccaccaaaacctgggttgaccgtcatgagaagcacctgatccaccaagttaagcacaggctcaatggtcacaagcggcgtacctggattgatgaccacacccaccttcataccagcagcacggattttctgcaaggttccatgcaagtgaaccgttgcttctgcatgaatggttaaaatatctgcgcctgcacgtgcaaaggtctcaatatgattttcaggattggacaccatgagatggcaatcaaaaaccagcttgctatgaggacgcatagccgcaaccacatccgccccaaagctgatatttggcacgaaatgaccatccatgacatcaatgtgcacatactccacacctgtcttttctagacgcttgagctctttttcaaaatttgcataatctgccgccaaaatagacggtgcaatcttaaaatgtgacatagagaaccaactttctatttgaattttttactgactttagtataggtttcacgctgattttggatttcgctgaggaattggagataattatcaaagcgactttgggaaatggcagagctggcaacagcttccttgaccgcacaatccggctcatgggtatgggtacaggtcctaaatttgcaatcctggctactttccgcaatctctgggaaacaatctgtcagagcctccgcctccttgacttcatagtctagggatgaaaaaccgggtgtatccgcaatttttccaccgaagacattgtagaagctgaccgcacgagtggtatggcgaccacgccccagactatctgaaatcgcccctgtttccaaggctaattctggcgcaatgcgattgagaagagtcgatttcccaacccctgtctgccccataaagaccgtcaccttgtcctgtaaaagaggcatcaattcctccaaactatagacaaaaggatagccaattttctcatagatagccttgaaggcatccatctccgtccgatcttctaccaagtccatcttagagatatagataatgggatccatatccttctgttcaaggagaactaggaaacgatccagtagattggcattaaaatcaggttccttggccgacatgataaccaccgcctgatcgatattgacgataggaggtcgaaccaaactatttttccgctcatgaatctttaatatatagccttctgagttttcctccgcagaaaagtccacaaaatcacccacgtagggcgtttgtcccttcttacgaaaatttcctctagctctggtttgataaatctgtccatccgcctcgacatagtaaaaacctgccaaggccttgataattcttccttgcaatgaagactcctttgtgtgtacttgttcctattataccaaatttcctaagaaaaaaggagcaggaaagaactcgaaccttaataaaagagcgcgtcacccgttccacgtttcaagttgttgagctgaaacagtctattcccagactgtttcaatcccacccccgcacagctcaaactgtctgggagacagtttgaggttggatataaagcgaactttgttcgcaacagtcgtaatggttagatttggagtgtaaaacacgaacgattctaccaatcaaccactgcgctgagatgttgacactaaccttatgaagtgagatggtcttttacccagactctgagattttacactttactctagtcatttcaaataaaaaatagtataataaaaagcaagcggaggtggtggaacggcagacacgcatgcttcaggcgcatgtgcccatcgggtgtgagggttcaaatcccttcctccgcatgataaatggagagaccccaagtcaaagttgatgacttgggggcatttttatatcttctcactcatactcaatgaaaatcaaaaacagactagctccaaaggttttgggaacctttggaggttggaaatagagcgaacgtagttcgtttctacttacgcagatagaaccctgttactattttgtttcaaaggaacaggctgggagtgggaaagaactcgaccattcatagaagagttcgtcttcccaccccccgcacagttgattaggtcagatttggagtgtaaaacacgaacaaatctgccaatcaatcactgcgctgagatgttgacactaattttgtgaagcggtgctgtgctttttgcccagcctcgctcatcaaatcaagtcaacaacgtctgattttgattttcgaagagtattaattgctctccccaatccgtaccaccccatcataacggctaaggacctcatcggacacgcggtgggaaatatgaatgagcgtcttatcagctagtgaggcaaggtaattttcaatcactgcataggtttcctgatccaaggcagacagactttcatccagcaacaagatatccttatcttgcagcaaggcacggatcaagagcaggcgttgcttttgtccaccagacagtccgctatcatcactaatttcctcgctcaaagaagcataacttgggaaacgactgtcaaggttcacggtcttaatgtgaaacatcagcctatcttctggaacctcccgtcccatggtcaagttatatagaaccgtatcatggaaaagggatccctcttgtggcagataggcaatcttgtcttgaatggcttggtaggataagtctgaaagagagatttgatcaacgtaaatatcccctgcttgcagttggctattcttggtcaaaataagagccaaggaagatttgccagaaccactttccccaagaattaaatacttcttgccacgctcaaacgctacggtcaggtcttcaaagacctgtttttcaccgacagcataactagccttgaccagttgaatactctggaaagctgaagctagttcctgtcccttcgtttcttgaccaaaagtagatagctcaaactcttgctttaatttcttaacggcatgcctgtccaaaaaggctgccgcaatgctattaatgggatccaccaactgctctgaaatggtcagaatagctgtcaagccaccgatggtcaaggcaccagaaaagacttgaaaaccaccgataaagataatcgaaagagtggtcagataaaagacaaaaccgactaagagccgcatggttactgtcgttcgagtggcctgattgaccttgtcattgactgcttgatagcgatcgttcagaccatctaaaacttgctgtctttggtggctatttttcacttgcaaataactcagaaagacatctgaaactcttgtattatagacctgctgactgtccgaaatcgcctcctgattgagccttctccgctttttaaacaaatagggaatcacaactggtaagaatgagatcagaatcaagaaaatagcggtcagaccatccaagctaagaagggccaaactggcaatgccaaaggtacaagcaccttgaaaaattgtaaagaaagcgtcgtaataatcttctttcaccgtctccaaatcattattgagctgagaaatataggcccctgccccctgctcaacaaactgcctaaaaggtaaatcaaaaattttcccaataaaggtcgcctgcaattggaaacctacttgattgagatagctgacattggcaatctgacgaatgtattcaaaaaccagcatgacaaggacagttaaccccatctgcacaaaataagacacaaaggcctgtctatctccagctgcaatagcatcaataatatagcgatattggtacagaaagccaacatttagcagggctactgcaaaaatacaagataaggttagccaaaaattcctctttttcatttcttctccaccattttatagatttcttcgcaaatatttctagttgataacccaaccgtctggagcaaaccttcccaatcatttattttccttacaatattctgttcgtgattttgcattgaatattcttcaaaattttgaagagagtaagaagaaaactcaccatccggaaagaatgtacacggcttaatatggccactctcattgattgtccattcaataacacctgctccgcaacgcattgtcccatctacaatgtcttcaaaatagttaaagcaattatcttcttcccatgtatgtatattaattctgctcccatactctctacttttttctataagcatctcataaaattcttctactttagagggacttaaaaaccaatctgatccgactaacttacctctacccaaatgactaaatagcccaaatctcaccgcttttacttggtttagtattaaaaattctataaaattatcaaattcgtcgataagactgtttcgaacaatattggtcactgaatagtctaaattctcattgtttagaaatcttattcctctaatcgttttatttaatgtatcctttccattggtaatttggtcgtttagaatcggattatgatgatataaagaaatttgaatgtagctcattcccttcaaataaattatacttttggaattaattaaatgaccagtggttgtcattgttacttcttgaaagttctccgtagcatattttgaaatctctttaaaatgaggatgtgccatcggctccccacccgttaactgtatttcataaacctttccttttaccctatctaaaaaatttattagctcttcatacttcaaaaaattcctgttaattggtccagcttccttaaaacagtgtgtacactgtaaatgacatttattcgttaattctataactattttcctagggtaaaatttcccaacttcaccataaatatgcttcggataaacagaaactcctttaacaataaactctttcttcaagaataattttaatgtatccaataatagcttttttatttttgtttcacattcccccgctatatcagagaagtaacctatcaaactttctacactacccgtttcgtttatctgttttaaaactaacgcttgatattcatttaataagtattgaccgtattttcctataaccatcaaatcttcaccaaagtaatggtagtagtaatcacaatttagcataaatttcattatcatattctccttaaaaatacgtaaatttatttaatggaatcaatacactattatgtttttaaaatacaataagtttaatcaacgaaacttgtagcgataataatataaaaaatctctgtcaactagactaattttactaatcgaaaaaccaaaaattaataccatccttttgtttgctgtgttctttttgttccacatccactgagggtttcaattttacttacttttaataattttgaagacaactttttaaattcaattacagacatattcttctccttttcttgtccaataaataaatttacgcattattaataataaattataaatataggacaacaaaatatgtcccttatacgcaaccactactcaataagtatcttttccaatatactttcataccaatctgctatattctggctatcgaccgctcgtaaaagtccaatacactttctcatctccaaaatagcattagaagttccggtattttgataatcataaaaagccttaccaaatttaaacaaaatgcgttcaaaaatttctgtctcgtcgaaaagcaaaccttcgatagtcttttcaagaaagattgcgtcgacaagttccttagtttgaacgctgactagataagcactaaggagaacttgagaaactaccaatcgatgttgtttcatttcacggtaaaactgtgtacgatgaattaactctctacaaaaaagcatcattgtttgatgacccaatttgtcaatcgtattcgcaaatagtaagatctcatagtagctccaattctcaactcgaaataagtaatccgttaaaaaggctgtatcttctttcgaaacaactattgtcttatctaagtttctcagtttataagcgattaaaatagcattcaaccgatgaaactccctacgagaatctctttctgcttttgctaattgttcagacaagattttctttatggttacaacatctctgatatagatggattgttttagttgttccaaaattctagtcagctcatcttttttgaaatcctgactggcatacacgaactcgtccacatccacattcatttctgccagcacaccaaataatttactaacagtaatgtcggattccccattttcaaaccgagaaagttgagaagtagaaatatgtcccttggcgacctccgccaaactcttcccctttccctctctgataaatttcaacgttttcccaaaacaactcatttccagacctccttttgtatataagggatttgtttaaagcataacttaatagatgttatcatgattttaaaataaatattatctatattcaacaatggggaatatcaatgaaacaaaattatctaattgcaaacattactatcgttttaattttacttattagtatcctaaaagacattccaccaatcattgttataaaataataatactcaacgaaaatcaaaagtagaccaccttcaactatcttccagatagttgaaggtggaaaatacaaaacaatgtttgcgtcttcaagccgacgatagaacactgttactttcttattttaaggtaacaggctgaaaagttttccattcatcaagactcttgacaacggataattttgatttttgaagtgtataaacacctttattataccactccttcccatatttgtgtccattttcacataaagaaaaaccaagccagctatctgacttggtcgtgattttattctgtcgtttcagtcgctactttgaaaaaatctttgtatttcaaaaggtatccttttcctgtagataggtcatattggaccagtttgagttcttctgcaactttcgcatctcgctcagcctgtcctactcggtccttatgaagtacttctgtcaagagggcatagtaaggactgaccttgttattggtcgtctccagcatcagtgcattcatgtcgctagagttaactagctcataattgtatttcgctgtatcaaaattgctccaaacgaaataatctgtcttatactgcgcacttgggtccgtcacgaaagctgactctggatacaaacctggcaaatggtccccgtaaaaaacaactgtcactttcttatccaaggtcttaagctggtctagaaaatcccttgttgcctgatccgtaaaggataggaggcgaacatagctggtcaagttttcattttcctcagccgtgaagccctcacccgatgctattatacctgcaggctctagagaattccactgaacatggttctgcatggtaatagccgacacaaagctggtatcggcagaacgtacctgatccaaaatcaagtcataggtcttcttgtcactgacaaaattcccctgataatcctcagccgtcacagtaagaggatacttggcactattgagagtgtagaattgctcaatccccagctgcttatagatagaatttcggttgtaactggtatcgtagtaaggatggatggcaatacgattatctgctggatagaggtcactgatacttggcaacttcttcatatttggcgccacatccagatagactgaagaaatggatgagctgtaattgtagaagggcagaccactatagacctgaaattcgatattagccgtaccaccaccatagtggtcactcttcatcaagccactggtagtctggctcatgatgtactcaatatttggaaggacattttgactaagggttacacctggaatccgacgcgggtcagccaaactctcactaagaatgtagataaccgtctggtcagtcaattgacctgtccgttctgcattgatttcctcagccaaggcggtatacttcttcacaatggccttcatggtcttctcagagtaattctcaggcatttccatactggtcttgctgagttgctgcaaccagaggaatgaaagagtgcgataacgagccacaaaggcgtagcccttccaatctacattccgccagttattaacctgagaaagaataggaatccagccagcaatcttatggtctttttcattgcgaattgcccagcccattcctaaaatcaaggatacgatgactgaaattcctgccagccttttccagatagaagcgacaatccttccttggaagtacttcttgtgaatacgtcggtagataaacacaaggaggactataaagacgagcgataccaagacaacacgtagactgataaagctgagaatcatccccaagttcccgacccatttgaaatcattgggggtcaatggctccgaacggtagcggaatttgagaaaattggccgtaaccaaaatgacgtttagactagcaatcacggcaacagataagatttggcggttgataactaggctaatgatgacattgaggaaaaagaggcaggcaatctggaagacaatagcccctggaaagagatgacgtgtgaaataagaaccagtcgctccagccatagaagcctgataaccaatatgcgatagcgtagccagtgccaaactgataaagagcatgctgtagacattggttcgattggccttaaactctacaaatgccttatgaagatagcgaagaaaaatgtaggtccctataaaatggataggtgcaaacaagggtgtctggctgaaaaactctatgtaagaacctttctcaaccaaactctcataatggctatctttccaataagatatagctagtggactgagagaaagtaagctggtcaagagcaaatagccatctggtaccaagtgattggctgaccactggcttaatttttctcgaattcccgtcttcttccgccataaaaatgccaacaatacaggaagagccaacatcaatagaagctcaaattgaaagagattattccggaaaatattccagggttgatacttcttggcattgagccgatagaccaggttgataagatatagaaaacctagaaaatagccgacatacttggcaaaggttttggtctttataaatttctcatatttatcaagcaagaccaatacataaaatgtaaaaataagataggcaatcaagggcaagggaataaaccagagtggaaaagatacatcactcagtaaaagggctcgccccatagccagcaagacggtcattaccatgaccagaataaattgcttggttgccttgagtttgatttgtttcatagcatttctctcttaggaaatatttgattttcggtagataaaggtataataaatcgaccaaagtatccagccagtcaaactgataaagataactggcaataaccaccattgttgcttataggagaggattagggtgttcttccctttttggctggtaaccgttggcacaccaatagtggaaagataataatccatcttccctaacctctttccattcaatgtcaattcactatctcggtaaataacaatcggtatttggatttcctctgattgatttgccgaccaacttatttttaagctatccccaaaaacttgcttattaaattgctggttaggtaaaataatctggtcacggtaacgatcataacgagatttagcctcatttaccgcacgaacattctcttctttttcagataacaccggcacatagtcgggagttgatttctgagccagttgaacaaactcacctaaattttttgaatgcaaggatgcacgtaattcttccgttgttccgtatagagtagtatgaagcatatcttgtaagaattctgctttgttgtactggtcattgactgcttgattatattgatcccaagtaaaaccaacaccaattatggtagataagattgtcaaccccaaaaacaactttttacgtacttcgtaatctgttaattgaagaccaacaatcgtcagaagtaaagcattagcatacaaaaagaatctaaagggaaattggattaaatccactaatccaatacctttaccagcaaatagttgccacggaaaaagatttgttgaaaaaataaaaaataccagaaaagttactgtcagacccctcaatatcaccgattgcttcttccattttttcagcataaaataaagagaggttgcaaaaatgattggtagagagtatggaaagtataagaaataagccttagaccaggtaactgttgactgaataaactttttgtttataaatggtgctgctaattcatttgttgcatttacatataataagggtaaccagatatttacagttaaaatcagaaaaactccaaccgaaaacagtacatctttcattacgttccatttgtcttgcgattttaaccaaccaattgaaaaaagaattgcataggctaagatgagaaacagagccgacagcatgtgtatctgcaacattaaccctacagctcctgccatcagaaaaataggaactttaccagtttttaggaatcgaactgctggaatcaaacaaagcggaaataaggccactccccaacttgaaaatccttgagctacccaccagtattgaacagagtaggtagtcgcgaaaaacatggataacccaacagatagagaatagagtactttcacttctcgcattagaaaataaagcgaagtggcactcaaaactcctaaaagaagattagacagtagttggtatcgataccaagttccggccaacaacagcaaggctccttgcaaataggctagatatggaccatatagagcattgacaatccttccagattgctgatagccatgcaagctcattatataagaaaaatctcctgacttaatttgtatagctgtatcataaaaacgattataatgaaaaacaatatcgtctcctgtcaccactgcttttgtcaaaatctgtggcaatagaagggtgagcgaaaaaagaaaaaatacagttactgcaacaatatctggatgctttttcagtaatttttttaacataagataccttcataaaaaaagagggaacccctctcttgtttttgtaagaacctgtactcagaagtgaagtgattatcaataagagatagtttttcgctaatcaaggcagttttattgagagaatactgactgtactttgaaaaaactaacgatgactagcttaaaaactatccttaagtagaagtgctgaactgtgaatacgggttcttactattctgctcatttgcagacaataattccttaaaatttatcaactcccagtataacaagctttccccccactgtcaacgaacaaggcaaacaggaaaacaattttccattaaaataaatattgattgcagatttctccgcaatcaatacttgcttataaaccaacttcctgaagactgtcagacaaacgtgcgaagtcagccatggaaagtgcttcgccacgaacactggcttccagctctgccatgccaagtgcctgcgtcagcttgtccttgacttcttcggatttgccgaaatggttggtcaggttgttccacagggtcttgcggcgatgcacaaagctggccttggacactcggaagaaaaaatcttcgtctttgacgctcaccagaggttgctcgcggcggaccattttgagaatggcggagtccacgtttggtgcaggcacaaagacggtgcgaggcacgataaaggccaccttggcagtcatgtagtactggaccgcaatggacaggcttccgtaagccttggtgtttggctcagcagaaatgcggtcggccacctcccgctgcatcatgaccacgaactcgctgaagggaatcttgctctcaatcaggtgcatgaggatagaggtggtgatgtagtagggcaggttggccacgaccttgatgggcaaatcagggttcttaaagttctgaatctgggtctgcaggtcggtcttgaggatgtcttggttgaccacggtcacattgtcaaagcgacccaaggtgtccgccaaaatcggaatcaggcggtcgtcaatctcaaaagccaagacctcagcggcattctccgccaaaaactcggtcaaggccccgattccaggaccaatctcgatgacattgacatttcggtcaatctctgccgtgtccacaatcttctgtaaaatattggtatcagtcaaaaaattttgaccgaaggatttcttaaaggtaaacccgtggcgttcaaggacggcacgagtaacgtttttgtctgcaattctcatgtgtgttctttcttgttttttatttcgccatttcactcaatcgtgaaataacacttagttttctcatcgtcgctgtaatgtccagctgtttttctaaataattggtatttagttttttctttcgagcatctctcggaagatacatgtatagacattgacttcccagacgcaactcctcatcgccaaagtcttggtgcaataatttgtttaatttttcaccatttatctcatcattggtaaagaccaaatgaacacgagaaggatcatagccctcaccaaaagaattttcagcaactgcttgtgttaactccatctgatgtttgacaatgatcgctaactctgcacctattttttctttaatggtttgatggataagccgactgagttcttcatctaatatatctgtttcacaaacaacatttccgctttgaatataggtttggacagaagttaaaccagcttccgtcaaaatttccgccaagtaagacatcttgggaattttattcttgccaacaggggtaacacctcgaaggaggacgacttttttcatttgttaatccccctcacctataatgatcctttagcgacaggatgcacaaccgatcagcttccaccatataaatcaaccgattctccgcatcaattctccgagaccaggcaccttgataatcatacttcaaaggttctggtttggcaatgccttcaaaaggatgtcgctgcatatcctggataatcttattgattctcttcagtgttttcttatcctgaccctgccaataaagatagtcttcccaggcgtcgtctgtaaaatggattcccatgttagtccgcctctatcaggtttcgttcttgggtttgtcccgttttgactttagccataccacgtaggactttttgagacagataagtgttccgagcaacagcgagggtttcttgtaaactatcccactcactctttgagagtacaacaatatcttcctctggatttttattaaccacgaccaaaggttcaaactcgtcattgacctttttcatatagtcctttaagtgatttcgaaaatgggaatatacaatagcttccataagcaatacctctcatcatttctaggcttactatagcatagaaaaaaagagttgtcaaacttattgtacaactctttaacgattctccaccttccattcgccgtcttcaaaccagtaaaaattctccgtcagctgcggctgttcaaagatttccaacatggtttcaaaaccgtcagcaagttggagattcttcaattctgcacggtcaatccagaagacctcgccctcatcagaagattggataaaacctgaaaaataactggttttgtagcaaaataccagatagcgataatggtcagtaggatccgtccagttttgaatgccacagagttcgagattggataccgtcaagcccgtttcttccttgatttcacgaatgacggaggaaataattgactcatttggctcgacatggcccccagggaaagtcacaccaggccatttctttgaattcctatcctgaactaatacctgctgaccgtctgtaatcatgcacatattggttaggatgacttgctctgtcctactcatgctctctcacttcaacaacttcacataatcactcttggtcgcaaaaagatgaccaactcgaacttcatttttcactacgcgatagagggcgatgtagtcttttccaacgacatagcctcgggttagatgaggcgggtctatctgcttaccaaaacggttatcggcgttaaaaccacgttcaggaaaaatttgcaaactctctaatgcttcgacaatcatcccaattcgtcttttggcaatttcttctgagaactgttccgaaaaataggcgtaaataactgccaattccttctccactgctggagcaagtatcactgaataagactcaaattccatacttctctttgacactttctaggctgatcccgtgacctgcctcaatcgcctgttggttttcctggatttccttctgtaactgtaaaaacaactcttctctttccaactcttcttctgtcagaattggcaactcattttttacagcgatattttgcaagaagaggttaaaaccagcagtcaaatccagctggttcatagcaaatacttccttggctttttctaaaagtctggaatcagttttaaaatttacttgggcatctttatttatagttatcaatctagtccacctcctagttttctatattttaacacaaatagacaccgctagcaattttcaaaaaagcagaaatagtaatatttccgctctagattgcctatctccccaaatcatcaaaataatagagattcaaaaattcttcctcagtaactggacgttcaaaattgtaaaaccagcgatagacttccacggctagtccatcaaactctaccctgtcgtccatttcttgcacaccggcaatatgaaacaaacggctctgcttccaaataccatccgcattgacatagccatcttcaactaaaccaagcaaatagtctgctagtttgttcttatcaacctgctcatcctcccaaacaaggacatcagccggcagcaagtaggtcacttcttcataagatgaataattttcataagaaggttcaaactcgtttttaaccaagcacttaacagcgtagaccctatccatgatagctctccatagcctcctcaacctccgccaaacttatcccaaacaattccaatcgtttgaggagttgtttgccgttgcagtagccgatgcggagcttctctcccagatactccctccgcttgcgactgtcgccacccataagcaaccctagccgaatcagggtcttctggctaatatcaaagttattttcatcatcgtaatgaccacgtacgcctgctagggccttttccaagtcttcaaagctggcgtgctcaatgcccaaggaccgcccttttgttttggacttgggggcagcctcgtcccgctgtaaaaaagcgtgtttgaccgtgggaatggcctgtataatgatttttcgaatccgctcgccattgtagtctgggtcagtaaagataatcacgccacgcaggtcatggagtttctcgatgcgttccaagtcatcgtctgatatggcagagcctctggtttcgtaggtatccacctcgtaaaaccgcttcaagtttgccgtgtcgtccttgccttcaacaacgaggacttcttgtatcttaattttctgagtcaattctgaacaaactccttgcattctcgtaggtcgcagccgccacttcttcgaccgactggttgcgaagctgggccagcatatccaccacatatctggtgtagccggtgcgattttcccgaccacgcttgggaacaggcgccaggtagggtgcgtccgtttcgaccaggattttttctaagggcaatgcttgcgccgcttcctgaagttcaacggcttttttgaaggtcaccactcccgagaaggagatgtgcatgcccaggtccatgaaagcttgagcctcctccagagtgccagagaaggaatgcatgatgcctccacgcggaccgacgccgacttccttgatgatctggtaagtatcttccaaagcatcgcgagtatgaaccacaaagggcaaatccaactgcttggccagctccatctgtcgcttgaaaacacgagcctggatttccttatccgccgtcatccagtagtaatccagtccaatctctcccagggcaatgaccttgggatgctggagggctttgagcagatagttttccacttcctcgtcataagtgccagcctctgtgggatgccagcccagtgtcagataaatttcagggtgctggtcagcaagctccatagccttgtcaatggttgcacggtcaaaaccgaccacattgtggagggtgacccccatctccttggcaaagtctaattcttcttggacccgaccgtcaaactgctctacgttgaggtgggtatgggtatcaaaaatttgtatcatcgttccatcactttctttcctactattgtaacatatttcagaagattcttatgagaagaaaaaaaccagcagactcgagtttctgctggcttctcttttcatcttcttatgctactgtaagaactttacgtcccttacggcgacgagcagctaacacgcgacggccgtttttagttgccatacggctacggaaaccgtgtttacgcgcgcgacggattttacttggttgaaaagtacgtttcacgatgaatacctcctcttagattcttgtattcgtttagccggctagttttgatcagttactaaacataccaaactattttatataaattctgttcgtttgtcaagctattctgccatacttttaggaaagaatcagaaaatcattgaaaaaagaggactagcctctttttaatcatgatttccttcaatatctacaacgacatatcggttcggctcgctaccttctgaataacttgtcaaaccatccattttagagataatgcggtggataattttacgttcgctacttgacatcggatctgtatggtaggcttcctgctctgccaaaacacgttctgccaatttttgtgcgtagccttgaagaacctctgcgcggtgttctacataatcattcacattgattgtgatatagaaattacgctcataacggttgtataagaagttctgagccaaaagttgcaaggctttcaaaacttttccgtgataaccgataacacgacctggttcattggtatccacttgaatattgattgtacggcgattatgacttgtatcaatacgcgcctcaacatccatatcatccagaatttcttgtacataagctgtcacttccgaaacaacttgttcaatatcatactggggctcaatcttaatatctaaatcagcaaaattatctgcttgattttctgagatgacttcttgatttacgtcttccttagcagatgttgttgcatctgtagtagttagtaaatcctctgaaagaatttcaatccgacctgtttcttccaaaatcgttgtcgcttctttttcatttttcaagatctgcgctttaatatcatcatcaagcgtttgaccagacttttcaaattctttcaccgctgcaacaacttttcctaggtcaatcgtagcctctgaaacgctttttactggttcattgaggtcattaatttcacttggaacgccacgaactgctttctgattagccttaacaaccgttgtttcattgatgacatcaatatccacaatcgctggctttttaccgaaaccaaggaaaccttttttctcacgcgcaaccacagtaatatgtgctttttttcgaggaatattcagctctaccaagccattctggatggcctcttcaacacttgctcctgtaaatttcatcttctctctcctagttttcctatttctttttctgtgcttttttctgtgcccgtcggatttttgcctgacgctctttttcagcatcaattttcgcttgacgctctgctattattttaaacggattattgaacaccaaggtttgagcaacctgataggcatttgacactgtccaatacaaagccaccccactagcagctgccacagcaaagaaaaagatcatcacgggcatgacataggtcataattgtcatagccatattcttctcaattgctgatttattggtcaaccatgagctgaggaatgtaaacactgcagctagaatcggcaaaataaagaacggatccggctccccaagatttaaccaaaggaagtgacctactttcaaggcttcaacacgtgtcagagcttgaaagagggccaaaaggattggcatttgaataaagagcggaatcatggacgctctcatgctgacgccattctctttgtagagagcttgcgttgcttcataaagctgctggcgactttccatatccgttcctggatactccgcttgcaactttttcagctgaggttgaagctcctgcatcttccgtgaggaattcatctgtatttggaacaacggcaacagaagggttcgaattaaaatggtaaaaagtataataccgattccaatttgaccgttgatagataggaactgaataatgctggcaaaccagtaaattaatctatcccacgcatctgtagattgactggtcactggccctgttccgcaggctgttaaaacaattagagatgctaccagtagacctgcccatttaactttctttttcaatcacaacaccttcctggtatagtttagctagtttcaaaacatggatgaggttttgcttcatttcttgataggacaattcctctacaccttttcgagcaatgataacaaagtcatctgctaccagttgatgttggcattcaattaagatgtgacgaatcctgcgcttaatcttatttcgcatgacagcgtttcccaattttttgctgacagataaacctactcggaaatgcttttgctctttaggtaatcggtagacaacaaacctccgattggcgacattgtttccttttgtaaaaatgtcattaaaatctcgttcacgcttgacacgatagctttttttcaaactgccactccatctttcaaaattacttctattataccacaaaattcaaaaaagccaataaacataccgtttataggctttttgcgttctgaatttcctctttggcacttttcaactggtctgcaatcgattcaaaacctgtcccgccaagggaatttctacgactaacagcaactttggaggacaaggcatcataaatatctgcttgaataagaggcgaaatagcctgataggtctcaaatgatacatcctggagatagtgtcctgccttgctacactccaagaccagttttccaacaatctcatgcgcttggcggaagggcagacctttactagccaaataatcagccaactctgtagcatttgaaaagtccttctctgtcgattgagccatcctttccttatgaaccgtcatcgttttcagcatacccgccaaaatatcaattgaaatcaaaactgtttctgccgtgtcaaacatgccttccttgtcttcctgtaagtctttattataggttaaaggcagggatttcatgactgtcagtaggccaactaagttcccataaactctacctgttttcccccgaatcagctcagccatatctggatttttcttctgaggcatgatggaagaacctgttgaaaaggtatcggatagggtgacaaattggtattcatatgaacaccagttaatgatttcttcacacaaacgcgacatgtgcatcatgaggatactggcatttgacagaaattccaagataaaatcacggtcagacacagcatcaagagaattactatagggcttggcaaatcccatcaaatcagacgtcatctgacggtcaatcggaaaggtcgtccctgccaaggccgccgcaccaagtggggatacatttgtatgctgcatgttgaatgcaaagcgctcactgtctcggctgaacatgttgtaataggctaacaagtgctgagcaaaactaatgggctgggcatgttgcaagtgggtatagccgggcatgattgtttccacatgctcctgtgcaaggtctactaaaatctgacgtaggttggtcaatttgtctacaacttgaaagagtgtatccttcaaataaaggtgcatatccgtagccacttggtcgttacgagaacgagctgtatggagtttgcctgcaactgagcctattttctccgtcaatagactttcaatattcatgtgaatgtcttcgtttcgaatatcaaataccagcttgccagcctcatactcctctagcaattcttccagaccagcttgaatgacctgagcctcagcttgagagataatcctagtttgccccagcatcttgacatgggccagtgagccttgaatatcatacttggccaatttttggtcaaagcgaatggaggctccgaattcttcaacccattcctcaagactggcttcaaagcgacctccccataatttctttgcttccataggctcctactttctagctctttttatgaatttccgcattgaccttggttggcaatccccaaagcttgatgaaaccgactgccgcatcttgatcaaaggtatctgcactggtataggttgccaaatcttcgtcataaagggaatttggagatttccgagcaactactttggctgaccccttatacaatttcacttttgcggtgccattaacaactgcctgggtctgagcaagataggccttcaaggcatctgttgctggattgaaccacaaaccattgtaaatcaagttagagagttcatttgaaacaatcggtttgaaatgcgatacttcccgtaccagggtcaaatcttcaatttccttgtgggctgtcagaagggtaatagctcctgggcactcgtaaatttcccgtgacttgattccgactaaacgattttccacgtggtcaatccgacccacaccatgtttaccagcaatgacattgagtctttgaatgagattagcaagacttaacttttcaccatttacagcaacaggaatacctgctttaaactcaatatcgacatactcgggagtatctggtgcattttctggagaagtagtgatgccaaaagtatcttctggcgcttcattccatggattttccaagacaccacactcattggcacgaccccagaggttttggtcgactgagtaaggactgtccagatcggcaggaactggaacaccattttccttggcgaagatgatttcttcttcacgcgcccacttccattcacggacaggagccacgactttcaagcttggatccagggctgcaatggctacctcaaaccgcacctggtcatttcccttaccagtacagccgtgggcgatagtggttgctcctgtcttatgagccatttccaccaactttttggaaatcaagggacggctgagagccgataccagcggatatttttgctcatagtaggcatgggcttgtagggcaggcaaaacgtattcttgagcaaattcttctttcacatccaaaacatgcgattcaattgcaccgatggaaagggccttgtcatgaataaattcgagatttttcccttcaccaacatccatacaaaccgcaatgacatcatagtctttcttcaaccaagcaatcgcaactgaagtatcaagtccaccagaataggccaaaattaatttttcttttgtcataaactttctcatttctatatatattagcaaataaaacttagtgactattatagtgtatatttatacttttttgcaacatatttatgcaaattttcttaaaaaatgaataaatatcgtacatttccagaaaaatttccaaaaaaagctagagaatattctccagcttctaaaatatattcctcatcataactgattatggttgataaattttccgttcttttaaaattttccagaaataataagctaaactaaaatcaagcaatccatgaatagccgagccaacacccaccaagccaagcatcgttatccagtaggtagcagaagtttgttgccccgaagtaagcaccatcaccacaatatattctcctagaccatgcaggagattaagcccaattcctaatagtaaaaagcgcttagaatccatgagaatcggaaaacgcttgaccaagaccgcacctaaggtaaggaagaacaggtgcgtaagcgcccgaaatacaataacgattggaaaaccggcgaggaaaaagcctaaactagaacctaaagcaacaaaaatagcagtagctggtgaaataaacatggctataaacaaaggaatgtgactagcaagtgtataggatgctgggccaataatgattttaatcggcatcattaaaggtattaaaatggcaaatgcggttaaaattgcactaattgatagctgcttaactgaatttttagatgatagtgttaattgggacattaggcacctctctttctattggtttgattataaaacaaaaccttacaggtgtcaagacgcctgtaagatttattaattttctagtaaaatacctgcatgttttaaagctgctgaaagttcattataggcttgcacagatgggaaagagactgtatgtgtatgaactccttctgttaaattactcagtaacacaccttggtattgacctaaggcatccaaaaaatgatccctatcttctaaacttgcaatattcagcttgcctgataataagccgtaaatgggatgctcaatttcaacatctagtatttgagctccaccctctagcaagattgtcaattctttttctacctcttctggaccatgttgacaagctatctttcgaatgtaggctccttcagtagatggcaaagaagattggagtaagtaccctctcggagttgccaagacagcttctccctccgcacgaagcaaggctacatctccaacaattacttgtcgactcactccaaattctttcgccagataattagctgcaaggggataggggctttctcgtaaaagggataggattttcttacgtcgttctgttgctttcatacacattcctttcgtacacttttttccattatatcaaaattcctgtaaatcaacctttcctcaacccaaaaacggaaactgcagaacagtctccgttatcatctgctagtttagcaatgcttgaatagccgcaatgtccaaacgtttcatggtcatcacagccgcattgactgccttgaccttttctgggttagccgtatcgtatgcttccatcaaaatacgcggcacgatctgccaagaaatcccaaactggtccttggcccaaccgcaaatctccgcttctggaactgccgacactttttcataccagctctccgcttcttcctgactgtctacatagaccatgaatgagaaggcttcgttgaaagaagccacgccaccgtagccgtggtccataacaatcattttctgtccagcgacaagaagttccgcataattcagtttggcagcctcaacagcagcctccccttcaccgtagtaggaaagttgaccgacactagcctgagggagcttgtccttgtagtagtccaacataggctgggccaaaccgacctgttcctgcgagaagagcaggcagatgtcaaactgataaggcttgtccaagtccggtgcataagacagttgccaagacagaccaaagcggtcttccaaccagacatagtaagggctgaaaggatattctcccaaaggcatgagaatacgaccgccttctgacaaggcttggtacaaacgtgtcacttcatccttgtcggctacattgaccataagggacatggactcattgagcgtaaagtatggacccgcactaatagccgccaaggtcatatcccccagttgaaactgaatcaaatccgaatcaccagaaggcgtatccgtaatcgtgtaggtccagtcaacattgccaccaaagaggtccacataaaaagccaccgcttcttttgcctctgtatcataccagagatgaggaataataggttgcataaatttctccttttctttcgtctgcccattataccacacacttgtccgtacaagctcacaggaaaacttcctatgctataatagaaggatagaaaaggagcaagctatggaaatctggaatgcctacacagccgacggtcacttgaccgaccacaccctcacacgcggagaatccattcccgacggcctctaccacctagtcgtcgagtgcatcatccgccaccacgacggcagcaccctcttcatgaaacgcgacagcaccaaaccctcctaccctgactattatgaagcgacagcaggaggttcggctttgtttggagaaatagcagagcaggccattttgcgcgaagtccgcgaagagacaggcattgagctgacagctgaccaactacgccaccataaacactttgttgcccatgacgaccagtgcattttccactgctactgggctgaaaccgactgggacaaagttgctatccaactccaagccaacgaaaccagcaattatatctgggtgcaacaagaaaatttgaaagatttcctggaaacagagctagtcattccaaggcagaaagactatgtggagaggctgtttttagaaagctaaattcccctaacagacaaatccccgccgtcacaggacagcggggctccttttatttcaaacctgcaactaggtcagcaatatcggctggtcgggttcggcaacaacctccaactaccttggcacccagttcgtgccattcaagtgtgttgtccagaagagaatggctgtcgtctgccttttccttccaagtttgagtggctccatcatagacttccccagaattcggataggtgacaaatggtttatccgttttttctctcaactgactgagaaaggctggatagagcgagggagccgtacagttaagaccaaccgccaaaatctgctcactgctgttgaccagctctgctattttttcaatagacgttccgtcagaaatcgactgaccgtcttgtgaggtgaaactaatataggcttcagcctctggaaaatcctctgccagcaactctactaaggcttgtgcttcaagaacatttgggatggtttccaaggctaagagttcagcctcctgttctaagaggagttcaattctgcgacggtggaaatcttttaattctgacagactaatgttgccataatcgcctgtatattcagcaccgttcgccaaataggctgcgtagggacccacgtcacctgagatgagaggataggttcgttgtactttttcagcttcagacaattctgcccaaacctcatcacgcgcttccttggccaaatcaacggtcaagcgaatgagttcttcagcctctgcttgtgacaaaccaacttctgctaatccttcaaaggttgcctgataggttgaagtcgtgaccaagtctgctccggcacgaatataatccttgtggatatccttgatatactggggattctccaaaagatacttggctgaccagagcttacctgatacatcatgacctcgaaattccaattccgtcccaagagcaccgtgtaaaatgatgtattccttttgttctaatagttctttaaaacgacccatactagtttctccttaccacttcttgaagcggatgtagtgataaatatagcagccaatcatgaatggcacaccaaagtaaagaccggcacgctgagaaggatcccaaccgattccgatgatggaaataaccaacaaaacaaccgtaatccacggcaaggttggtgagaagggtgtcttgtattccaattcatcttcgctatgattcttcaaaaattcacgtcggaaaccgatttgtgccaatggaatggccaaccaagcaatcacaactgcaaaaccagcaatggaaaccagagcaaggaagatagtatcttctgcataaattgacgcaaccaaggcaatcacaacaccaatcatggacaagatcatgccacgcattggaacaccgtgtttattaatttttaccaattccttgctaatcatgccttcatttgccaaagaccaaagcatacggcttgaagcgtatagccctgatgtagaggccgataaaatagccgtcaagataataaagttcataatatctgcagcgtaaggaaaaccgattttatccaatacaagtacgaatggcgcttctgtcacacctgcttctgacataggaagtagggctgccaagactacaatggtcaagacgaagaagatgaccaagagaccgattgttgacttgatggcttgtggcacggctttcttaggattgtcagtctctccagcggcaattccgatcatttccacacctgaaaaggcatagttaaccgacagcataactgaaatcaacccaactaggccgttaggaagtaaaccttgggctgtaatattagtaaagagcggcgcagcattggttccctcaaatggcaaaataccaaaaatagctaaagtcccaagcacaataaaggctgctatggcatagaccttgatagacgagagtgcatcctccgccttggcaaaccaaccaacagaaagggtatttagcccaaagacaataactgcaaaaatcgtcgcaaaaatccaaatcggtacactaggaaaccagcgttgcataagctgtgctgctccaacgaactgagaagctagagcgactacccaacaaagccaatacatccaggccaccataaatcctgttccaggactgataaacttggtcgcataggtatgaaaagaacctgtgactggcatggctaccgaaagctcacccaaagaaaacataaccaaatagaccataacagctccgaaaagataggctgcaacagctccaaatggaccagcctgtgcaatggtatagcctgaactcaaaaacaatcctgtcccgataaccccgccgatggacaacatctgcaaatgacgactgttcatctcgcggttaaaggtcccttgattttcaaaattatgattttccataaactctcctaaattcttgtgattattctatcataccatggattttcaaaaactggttatatcgttttcaatccaggtgttatagcttcaaactatgacaaatccccaccgccatatgacagtggggattatttcattacaaactcttcaacatattgtcaatatgctggatggatttttcacggccgagcaggtaaatagtatttggcaactcaggtccatgcatttcgcctgaaacagcgatacggattggcatgaagaggtttttgcccttgatgcctgtttctttttgaacagccttgatttgtgggaagatgttatctggttggaaatcttcgtccgtcatggcttccaatttttccttgagggcgttgagaacagttggaaccgtttcgcctgccatgacttctttttcttccgcagtcaattctgggaaatcagagaagaaaaggtctgtcaaaccaacgatttcatccgcagatgacatctgtggcttgtaaagttccaccaatttttctgccttgtctgtcaaacgccccgcttcttccaagaatggcttagcaaggttgaaaatagtttctaaatcagcatttttgatgtactcattgctcatccagtccattttcttctggtcaaaggcagcgggtgacttgctgagacggttctcatcgaagagttggataaattgctcacgagagaagatttcctcttcaccacccgggttccaacccaaaagaccgataaagttgaagacagcctcaggcatgtaacctttacggcggtaatcttcgatgaactgaagggtgttagtatcacgtttagacaactttttacctgtttcagaattgataataagcgtcatgtgaccaaattctggcgcttcccaaccaagtgcttcatagaccatgagctgcttgggtgtgttggcaatgtggtcatccccacggataacgtgcgagattttcatgagataatcatcaatgaccacggcaaagttgtaggttgggtagccgtcacgtttctggataacccagtcaccaccgatgttgccaccttcaaactcgatctcacccttaactatgtcgttccacttgtagataccagcttcgttgacagccaagcggaccgttgggacaatgccagccgcctcacgctctgcgatgtaggcagttttttcatcctcagacataccaaggtattcgttgatgtagcgaggtgtttcgcccgcagcttcctgacgctcacgctccgccgccaactcttcttcggtcacataagacttgtaggccttgccttctgccaagagctgatcaacatacttttggtaaatatccaaacgctcagactgacggtagttctcatgggtttctggactctcatcccagtcaatacccaaccaacgcaggttttcaagttgagaacgctcgccgtcttccacatggcgcttgcggtctgtatcctcgatacgaatgaggaaagtaccgccatgatgacgggcaaaaagatagttaaacaatgctgtacgggcatttccgatatgcaaaagtcccgttggacttggtgcgtaacgcacacgaattggtttagtcatgtttctctcctgtaaaatttcaatcaagaacattatagcatagatatgcataagaaaacagaaaaatcagtctaaacagactgattttgaggtgttttttggttacgtgccagccagtagaagacatagaggactaacaaaccagttgcagctaggaaaagtccgctaatctgattgacagtcaagattaagaccaaacccgaaaccaacagtcgagtaaaggcttgacctagcataaaataggttgataccgctccgccaatggtcgccaactgctcctctggcatagaattgacaaacttagcgttaaacttaggtccactagctccagaactaattcccattgtagtaaggaagaagaaaataattggcagttgatgaagcaacattccgacaaaaacgccaagaagagagaaagtggctgccacttccagcgtcaccatgctggtatttttgaaaagggtaaagactaaggtcgagcccagaatatgtccgataaagaagatcagaatggtcagggcaagggttgtttcaacattgaggaagacgaggcctgggtcttcgctaatcagcaggaccagaataggatagagaatcgctccacaggcgttgataagagggttggtaatcaggaccaggcggaactcgggtatcttgcgcagctccacgattgcttgcttgaaagaagctagaatgcctggtcccttggtttttggctcagtctggttcggctgctccgctattttcaaaggctgctccgtcaggagtttgcgaaaggctggcgtcagcagctgcatgatgagaagggaggctaaaaaggtgccggcgttgagaaaggccaggttttggtaggagaggaggccgaccaagagggcagagagggcctgaaaggcgatgttgaggaggctggtcacggtctggcgaaaggccgagtactgctcccgctcttctttgggcgctacgcgtaatcccagaggtgtatagaggccgttttcatagaagccagcgaagtctgcaaagacattgaagctagctgccactacgacaatccagagggctggctcaaagcccatgcagaatccgaggatgaggtagagaaggacacgaaagagtaaggtcagcttgatggtgctgattttattgaccgtcttgtctgctagatagcccgtaaagagccccataaagctagggaagatttccgagaaggtcacgatcgccagagccagacgactgttgggcaccagtaaaacatagttcatcaatgccagataatagaccacatcgccaaaattggacaacatatccgcagtcagtacccataggtaagtagcatttttcaaaatctttttcatgataatccctttcttttgattaattttcagaatattctgattttttgtcctacagaggagcctggatagaccttcctctgcgattattcttttacatagagtaaatatttaatgtagaaaatgccatatcacccgtcaccaagagaatcttttcttttggctcagatgcgtagttgttagttgttgacatggcgctatccaactctacaaccgcttgccagtcagcaggcagatagagtgtgatatttgagaaggccgcatcgatatgaaaatctgccttattacccagaatcaccgcctgatcaaaatagactgtactagatccaaaggctacatccacactatcatggataaaattttcctcatggatgtatcgagtcgaggaaccaaaagctgtatcgcgtcccttatcgccaatcacccctgtgacaactccatgagccagtctgcgcttccttggtttaaaaattagtttcaagccaagacagagtaagacaagcgacagaaacatgttccaagtcccaaactccacccattcatagacagagttggcagctataaaagctaggccgaaacaaaagatactggcaagccaatccaactttaccaagcggtgaaaacctgtcacaaaggttaatacaaaccagacagtggtccaaaagggcattgccaaatgcaaacccaatgactccctcaacaagaccaaaaccgccagtcctataactgcagctccaattaataaacgtttcatcttcctacctcatttcctgtaacttttcttttaataaatgataataatgccgcgacacgtggacttccttgtgagtcttatagaaggaaatccgactggtgcccgagaaggacttatttagcgaatagactaacttgctattgacaatggttgacttagctaccctacaaaagtagatgggcaaatgctcctcaagttcatagagtttcatcttaacctcgtaggcatcatcgcctgtatgagcaaaaatcttggttccatccgtttcaaagaaaagtatgtcccccaatgaaagaaaatactcgctgctccccttgtaaaaaacaagcgagggacgactaacttgttgcaaagcttgctgaatctgttcaatctctggtcccagctggctggttcggataacaacttcaacctgatctaagctgtcatcaaattcaatcctaactttcatagctccctcctttttgatagctctattataccagttcgacatccaattacaagggcatttcagtaagtggcaaaattagacaggtaagtggtagaaataaactaagaaaagtcccttgcattacgcgagggactttatttttattatatgattttgaaaattgcagagtttttcttcttaaaaaatcgcatccagcaacgatgtgcttccaccaccaccatcaccacctgcaccgacaatatgattgccaatgacctgagcaaaggtctcaatgttcaaactctgtacatagatttctccataaccagtaaaggtattaacgattccttcacctgtaccgatagattggaggaaaccattttccatatggatattgtagtccaaatcacgactccaagcaaccacatgagcattgtcaatggtgatacttccaccatccaaagttagcttcttaatagaaccaaacgcattcgccaaaagtgtgccatggccctctgtagtcatcacaaagagtccaccctgaccaccaaagaaagctttcccaacactctggcgttccattttatactgggcagaaccgtcaagggcaaggaaggcaccatcatttagtcgatattgctctgcaccaagttccaaggcaataacctgacctggcgttgaaggcgcaagtgcaatttttccatcgtcactattggaaatggcttgcgtgataaacatagattcgcctgataccattgaccgaccgatggcccccatcaatttaccaaaacctgaaccaccacgcgcattgagcttggtattcaaggtcacactcggcgtatggtagaccatgctcccctgttgaatataagctgattcaccagcttccaaggcgatttccaccaaaggaaactgcatattactatcgatagtatatttcatccgattgtctgacatagttgactcctattttttacgaaaggtcctgttaaccacaggatagccataataaacctagaacaagctaaaataaaccaagtatcatttatctcttcatttgttctgttgtgataatacaattttatctcattcaaaaaaacttgtcaaggatttcccggtcattcagataaaatttacaggaaaaaccgaacttcctgagcattcctatataacttctgttatacgacccgtatccacatcataaaccgcaccagaaatttcaacgtcgtcaggtatgagcggagattgtttcaagagagcaatatcctcccgcacgctttcttcaatgtctgtaaaaggaagaaagtcctgaccagccacatccactcccaaatctcgcttgagttggactgcaaattcttcattggtaaaggtctgtgcaccgcagtctgtatggtggaggacaacgatttcccatgtaccgagctgctgctgggaaatgactagcgagcgaatcatgtcttctgtcacgcgcccacccgcattccgcagaatgtgagcatcccccagagccaagcctaaggcctgcgccacgtgaagccgtgagtccatacaggtcacgatagccaccttggtctttggacgaagaggcaaatggtaatcaccatgcaggtcaacataggccttgttggccttcataaagttttgaaaataagacataggacctccttgtctgatgagaatttctgaaattttcagaaataggttagacctagcttatcacattcccgactatttgtcgcaaaaagaggagcgactagctgtaactcccgaatgatttcatcagttgaatactttctgcaagacttcgccaatggtggtcacgccgataacggtgatttccttgggcaccttgatacctgtcagggaatttttgggggcatagaccttggtaaagcccaatttggcggcttcgttaatccgttgttcaatacgattgacgcggcggatttcccctgtcagaccgatttcgcccataaagcactcttgtgggttggttggcttgtccttgtaactggaagcaagggcaactgcgactgccaggtcaatagctggctcatccagtttgacaccgcctgctgatttgaggtaggcgtcttggttttggagcagcaggcctgcccgtttttccaaaaccgccataatcaagctagcacggttgaaatccagtcctgtcgtggtccgcttggcattgccaaacatagtcggcgtcaccagagcctgcacttccgcaaggattgggcgggtaccctccatggtcacgacaatagccgagccagtcgctccgtccagacgctcttccagaaagacctcacttggattgaggacttcgaccaagccctgcgactgcatttcaaaaatgccgatttcattggtggagccgaagcgatttttgaccgcccgcaagatacggaaggtgtgctgccgctcgccttcaaaatagagaacggtgtctaccatgtgctccaaggtccgcggtccagccaaggttccttccttggtcatgtggccgacgataaaggttgcgatattgttggtcttggcaatctgcatgagctcattggtcacttcacgtacctgactgacagagccttgcacgctggagatgtcaggactcataatggtctggatagagtcgataatcaggaaatctggcttgattttctcaatctcggtccgaatgctctgcatattggtctctgcatagagatagaactcgctgtcaatgtcgcccaagcgttccgctcgcaacttaatctgctgggcagactcttcccccgacacatagaggacggtgccaatggtagacagctgagtggatacttgcaggagcaaggtggacttgccaatccctggatcgccgccaatgagaactagactccccggtaccacaccgccaccgaggacgcggttgaactcctccatgttagtcttagtgcgagccacttgaatggatgacacttcattgagtttcatgggacgggtcttctcacctgtcaggctgacccgctcgttcttgacttcagcgacttccacttcctcgacaaagctagaccaggagccacagttggggcaacgacccaggtacttgggcgagtggtactcgcaggattgacagacaaaggttgtttttttcttagcgatggtcatttcctcctatagagtgtattctaggatttcgcagtaggctatagtttctttgggaacaaactggcgtatcagcataccgtgacagacgataacgattcggtcataggctttgtattttccaagggcctgtaaaaatcgctctctcatctccgcagcagtctcatagcgaacaggtgaagactcaggcaccgctccgctattttccaaaaataatcgatgagctaagacagcctcgtcttgactggcattttgccccgtcatatctggtcgccattcatgaaaaaagggctcgaccataagaggtagttgctgggcatgagcaatgtaggtcgcagtttccaaggcccgtgtgacgcttgaagcgacgactacttgagcttgggaaaagataggattactagcaatttcctgagctaaagtccgccccttttcagttaaaggagccaaatcccgtccaaaacctgcatacagccgaggattatcatgctggtcaaacatactgtagtcgggttcggaatgccgcacaaagagaatctgcatagtagtctatttccctgtcgatccaaatccgcccgtccgaacgccgtcggcctgatcaccgtcagccaagaggaagggggcaaaaacagcctgcacaatccgctcaccagcttccaccacgacggtttcctctgtgatgtttcgcatctgggcaaagatgtggccttcgttggctggattgccgtagtagtccccgtcgataaccccaaccgagttaatcaggaccagacccttcttgcgaggattggacgagcggtcgtagagatagaggacttcgtttgcctgcatataggcctttacacctgtcggcaccagcttaatctcgcctggctccaagctgacagtttctgcagctttcaggtcataacctgctgcatgagcggtctcacgttttggcaataagttttcatcagtaaactggctgaccagttcgaatccacggattttcatagtagtttcccttcaatttcttcatgcataatacatacgctctctattataatttattcgcaggctaaaagcaaaactccaacctagtggctggggttttcaactttattcaaacacaaactggttgtggtaaagttcggcgtagaagccatttagtttgagaagttggctgtggttgccttgctcgataacctttccatccttgaggacgatgatttcatccgcattgagaatggttttgaggcggtgggcaatgacgaagctagtccgtcctgcgataatggcctccatagccttttgaattttggcctccgttacggtatcaacgtttgaggttgcttcgtccaaaatcaagacttgtgggtctgtcaaaagcgtacgggcaatggaaatcaactgtttctgacctgttgagaagacattctcatcatcggtcacaaaggtttcatagccctctggcaagctcatgatgaagtcgtggatatgggtggcacgagctgcggtttccaccatttcctgcgaaatgctctcatcaccaaagcgaatattgtccgcaatagtacccgagaataacaccgactcctgcaagacgataccgaccttattccgcaagctatccaaatcatattcccgaatatcgcgaccatcaaaggccacactaccaccattgacatcgtagaagcggttaatcaagttcataatggtagtcttaccagatcccgtcggaccaacgaccgccaccatcttacccttaggagcagagatagacaccttgtccaagaccttctgacctggcaagtagccaaagtcgatgtccttaatttcaacaccttcttttaattcggtaaatagcggagcgttttgaggacgaacttcctcaggctcatcaaacatttcctgaatacgatgagctcctgtgaaagctagctgcaattctgcccagctggcagcaacctgcatgattggctggtaatactgttgcgagtattgaacaaaagtcaccaccagaccaagtgcggcagctgtttccagtgagctgtcattgagaacaatgctggaacctgcaaagataacaatggccgtattgaccaaactcataccattcataaatgggaagagaatcccaccaaacaagcgtcccttgaaagttgtgcgacgaacttcttcattgagctccaagaaaccatcaattgtctcttcctgcacaccttgtacaataatcgctttttgtccagaaattttctcgtccatgtaggcattgagtttagacaccgcagcctgttgcttatccgtatatttccgtgataggcggatgataacgaccaaggcaatcaaggcaactggcgtagaagcaatggtcaccaaggccaagcgagtatcctgacggaacatcatgatgaccataccaacataaagagcgatgttggtcaccacttgggtcaaggactggttgaaagcgttttggatattgtccaaatcactggtaaagcgagaaagtatatccccgtccttgtggctatcaaagaaggcaactgtcaagcgttccagtttgccaaacaagcccttacgcatacggttggtcgaatgagccacgatacgcgtgaagaggagagtgtaaatcaaggaagccacaaccgtcgccgcataggcaaagaaaagattgagcataaccccgttaaaatcagccatgtctggctgaaagtcagcctgaccagcttgattggccataaagtaagcctgcccgattttccccatctccgcaatggcatttccaaggaaaacaggtgtcttaacctgcaggtaggtcgctgccacaatggctagaaaaatcacagcaaaggacagtttatagcgtttaaaataaaaccagaaaaaacgtaacgtcttcatctattcctccctccctttctgtgtttcgtagatttcacggtaaacatcgttcgtcgctaccaactcagcgtgagttccttgtccaattagacggccttcgtcaagaaccaaaatcttatcagctttgacaacagaagaaatcttctgggcaacgatgacagtggttgtccccttcaaatcatggttgagagcctcttggaccagtttctcagacttggcatccagggcagaagtcgagtcatccaagaccaaaaccttaggctcaccaatcaccccacgagcaatggacatccgctgcttctggccaccagagaagttatttccacgttcttctacttggctctcataggtatcatccaagcggtcgataaattctttggcttgggcaatacctgcggcccgctccaagcgttgcaaatcagcaccaggtgccccttgacgcaggttgtccgcaatggttcccgagaagagaatagccttttgcaagacaatcgataccgtatcacgcagggtgttcttgctgacttctttcaagtcccgaccaccgatggacaccgttccttcttgcgggtcaaacaaacgcggaatcagttgagcaagagtggatttacccgcacctgttgcaccaaccacaccgaccatttgacctggctcaatctcaaatgagatatttttcaaagtcggctccgtatcgtgtggataggtaaagctaacattgtcaaaaacaatcttaccagtcaattcttcatccgccacatccttgaaggtcatagcaggttctgtatccaagacctcgctgatccgcttaatagaaatagcagcacgtgaagcctgcatccccatgaagctagtcatgataatggcaaacatgatttgcatgaggtaactcataaaggaagtaaagccaccgactgcctccaagttggtttccaacatcccggacaccaagtagagcgatgcaaaaatcgccatgtaagagataaacatcatcaagggttgcaagatagcaaaaccatagccgataaagaggttgaggtccaagagttcattggatactttcttgaacttggcatactgatttttttcctgtacaaaagacttaaccacacgaatcccacggaggttttccttagcaatactgttcatcttgtccatgagggactggaatttcccaaaacgtggtcccatttgccccatgacaactgccataatagccataatcaagaccaccatgagaataatcatccaccagagttctggcatggtccgcactgccatgataaaggctccgacaaacagcaatggaacccgcatcaacactgtaaagagcatcatgacaaggttctggatttgattgacatcgttagtcatccgaacaaccaggttccctgcgttaaactcttcgatattagcataagagaagctttggatcttccgaaaggtcttctcacgaatatctgcagataccccttgtgaaatttttgctgcagcaatggtattgacaagccctgccaaaagaccaattccagcaataatcagcagtaatttgcccacacgaacaatttcatccttgtcattggccaagactgctgtcaaaacatcctgcaaataactaggttgcatcaaggtcgttgctacgacaattgacgtcagcaagaccgatgccaaggcgtaccatttataacgtaaaatggcttctttaaacatgattcttctccttatagcgttgaatatttacttttaattgattgcccacctgtttaaccaagtcaaagtcctctttttgaatgccccaaaaaagtgaatggtgcatttcttcatgaaaagctttcaggtgacatatcttcccttgtcccttctctgtcaaaaccagctgtttgaagcgtttgtcaaccttagagggaaggacttggataaagccatttttctccattctcttgaccagattgctggcaaccgatttggaaatctttaattccgcttctatatcttttacaaaggtttcggcttccgaccgttccgcaatgaagcgcaaggcccagccctgtggaccagccaagtgctccacatcgtattcttttgcaatggtttcactaatttgttcaatctgattgagcaagttccgaaaatctgcaatagtatgtcccatgacagctcctttctacgaaaataattaccatgagaactattatagttctcttaagaactattgtcaattatttcgtttgctcttttctgaaaatattttgttatttcagcatcattacgcacttaaaacccataatatatataccgtataaattatataagattttatgtatcaattatggtataatatatctaaattacaccaactagaaaggattttttatgaccaaacaaaccattgccatcttgggacccggttcatggggcaccgccctaggacaagttctcaacgacaacggtcatactgtccgtatttggggaaatgtccctgaacaaatcgacgaaatcaataaagaacatacaaataagcgctatttcaaggatgttatcctagatgaaaacatcaaaggatataaggatttgagtgaagccttggacggtgttgacgcggttcttttcgttgtgccaaccaaggtaacacgcctagttgccaagcaagtcgcacaagctctcaaacacaaggtagttgtcatgcacgcttcaaaaggcttagagcctgatagtcacaagcgcttgtctgaggtactggaggaagaaattcctgctgaactccgttctgaaatcgtcgtggtttcagggccaagtcatgcagaagagactatcgtccgtgatttgaccttgatttctgcagcttcaaaagacttggaaacagccagctacgtccaaaatcttttcagcaaccactacttccgactttacacaaataatgatgtcatcggcgtagaaacagcaggtgcccttaaaaatattattgctgtcggtgccggcgctttacacggacttggttatggtgataatgccaaggcagctattatcgctcgcggtttgacagaaatcacacgtctaggcgttgctatgggcgcaaatcctctgacttacagcggtctttctggtgttggtgatttaattgttaccggtacatctgtccactcccgcaactggagagctggagatcagctcggtcgcggtgaaaaactcgaagatgtagaacgcaatatggggatggtgattgaaggtatttcaacaactaaagcagcctatgaattggcacaggaattgggcgtttacatgcctattactcaagccatctacaaggtcatctaccaaggtgcaggtattgaagatgccatcaaagaaatcatgacgggtgaattccgacatgaaaatgaatggcattgatttttattaaacagaaaaaataaaattaaaaggattacatacttatgaaaaaagttagaaaagccgttatccctgcagcaggtttgggaacacgtttcttgcctgccactaaggctcttgccaaagaaatgttgccgattgttgataaaccaactattcaatttatcgttgaagaagctctacgatctggtatcgaagatattttggtggtcactggtaaatcaaaacgttctatcgaagaccactttgattcaaactttgaattggaatacaacctcaaagaaaaaggcaaaaatgatttgttgaaacttgttgatgagacaacaggcattcgactacacttcattcgtcaaagccatccacgtggacttggtgatgccgttcttcaagctaaagcatttgtcgggaacgagccatttgttgtcatgctgggcgatgacctcatggacatcacagatacaaaagctgtcccattgactaagcaactcatgaacgactatgaaaaaacacatgcttcaaccattgctgttatgcccgttcctcatgaagaagtttctgcatacggtgttatcgctccacaaggtgaaggtgtcaacggtctctatagtgtggaaacctttgtggaaaaaccaaaaccagaagacgctccttctgaccttgctattatcggacgctacttactcactcctgaaatctttgagattttagaaaaccaaaaaccaggtgccgggaacgagattcaattgacagatgctatcgatacactcaataaaacacaacgcgtgtttgctcgtgaattcaaaggcaaccgttacgatgttggggataagttcggtttcatgaaaacttctatcgactacgccctccaacaccctcaagtaaaagatgatttgaaacaatacttgatcgatcttggtaaaaaattagatacaaagaaaaactagcaagcgctagttttttcttatgtcaaataaaatatccctaataatagggcgatcagacccagatagccaatgaaactgaaaaaaatctgttttcctgtaaagagatctttttccacaagaggtggaaggaacatcacgaccaagcaacctccaacagctcctccaatatgtcctgccatactaatggttggattaaaaagtcctaagaccaagttcaatcctaaaaggaccatgtagcgttgaccaagaacctgtagataagggctgcgactaaatttcctcaaaagtgccatagccgcaaaaagaccaaagagcgaggtcgatgcacctgcaccaactacatctggtgtaaaaaagagaacaaaaagattgcccattatcccagacaagagatagaggagaaagaagcgccttgagccaaacagtccttctaattgataacccaaaccaagcaaagtaatgctgttaaagataaaatgctcccaaccaatgtggacaaagatgggggaaatcaaccgccacaactgagtcggatcataccgcacaacttgaccatacatgccaccaaattcaaaaattgtataggctgtagtggtctgcccaaatcgaaatacttgtatcaaaagaaaaacaagagccgtgactgccaacaagccattggtcacaggatagcgcttatcaaaaaagttcttcaaaaatcaacaactccttcactggaatatcaaaaacatctggttcgaaatcatagacttgaaagtctgccaaggtcgataccgtctccccctgataatctgctaggtagcgatcataaaaaccaccaccatagcccactcgaaaacccgcttgattccaagctaaaccaggcacatggagcaacttaaccacagacttatccacaggttgtgaataaataccaggttcccaaactccaaacctagatttcaccaaatcatcaggattatattctacaaaatccatacgtccttgtgaataggtcttagggatgaaaatctgcttgccgtccttttgagcctgttcaatcaggtaagaagtgtcaaactcatggggcatggaaaggtaggtcccaagcgactttgcaccctgataagtatcagaagcaaggaggcgttccgttaactgctgactccatcttgctcgctgactactagtcagatctttcaaactctgcaagacctcttgccgaatgctctttttatccacagaaactcctttcttttcagaaaaagactggaaaaccagtctagtttgctttcattttcaaaaaatcactcaacttatccacagcaaagggaagcacttcctccttgggactaaggcgaggattgtggaggggataaggcgtatccacacccagccagaacataacacccggcaccttgttgagcaggtagccgaagtcctcacccgtcatggcaggtggacagtcaatcatctccactccgtcaatgccatcaaagtaggtcatgagttcatccgccaactgaggattattttccacaggtagataaccgctaggattgagctcgatttccaagtctactccaaaggacagggcgattccctctgccacttcccgcacccgcttttgcaccagaagactcatgttctgggtcaaagcccgaatggtgccgtgcaaaaaagctgtttcagcaataacattattggtcgtgcccgcgtgcatggagccgaaggtgaccaccgctccctcaatcggatcaacgttacggctgaccaccgactgcacctgagtcacaaagtagctggctgccaccaaggcgtcatttgcggtatagggaaatgctgcgtgcccaccctttcctgtaaatcgtatcttgacttcacaggtcccagcaaagagggtcgcacggttggtggccatttgaccaactttgaggtccggtcggacatggagcccataaaattcatctggtaaccaatccccgaaagctcccgcttcatacataagcatgccacctgctagattttcctccgcaggctgaaacaagaagagaagattatttctcggctgctgctctgccattttctccaaaagccccaaggcaatggtcatgtggaaatcatgtccgcaggcgtgcatcctgtctgggtggagggacttgaagtccaggcccgtctcctccacgatcggcagaccgtcaatatccgcccgccagccaatcgttttctctggagcagagcctgtcagatagaccagaatccctgtcttccaagtgcggacttgggcaaaagaacagtcttgaagtaaaccttcaatagtttccataagaaaggcgtgggtcttgaactcctccatgcccagctctggaatctggtggagggcccggcgtgtcgcaatcaaatctagcatagctacctcttagagtgtccgcaaagcctcttccaaggctgttttttgttgggtttgagcgtcgatttccttgatgatgcgggctggcacacctgccaccactacgttttcaggaacatcttgagtcacaatggcacccgccgccactacagaaccgctaccgatttgcacgccctcgataacaacggcattggcaccgaccaaaacgttgtcgccgacacgaactggctcggcagaagctggctcgatgacacctgcaaggaccgcacctgcaccgatgtggctgtttttaccaacggtcgcacggccgcccaaaatcgcacccatatcaatcatggtacctggaccgatttccgcaccgatgttaatcaccgcgcccatcatgataacggcattatcgccaatggtcacttgatcgcggataatggcacctggctcgatacgggcattgatattacgcttgtccagcaaaggcacagccgaattgcggccgtcttgctccaccacatagtctacattttcagtcaagtttgccaagagtggctcgacatccttccagtcaccgaagaggacattgccaagctttgtcacttcagcaggaacagctcctgccaattctccttcaaaggtcactttaacagttgtcttcttcacagcattaccgataaaagcaatgatttcttgcgcagtcattttttgtgcagtcataatgtttccaatctaaaaataatattttttctattatatcaaaattttctgaaaatttgggaagaaatgcaaaaaaatgaaaaagggagtgggaaagaactcgattaggtcaaaaaagagttcgtcttcccaccctcgcacagttgattaggccagatttggagtgcaaaacacgaacaaatctgccaatcaaccactgcgctgagatgttgatacgaactctgagaagtgatcctgggctttttgcccagcctcctaaatactatagaactctctatcctcctaaagcagctgacatttgctctatctgctgttgcaaaccatctctatactctttcaagaatgtaataatctctgctcttccaacaattgcagcatttcctaatggaccatattgttttttctgttgctcaacagattgtgataccgtatcacgcacagactggtacatagtggcatcacccaatccatactggctgaccatattttcatagttcgtaatatattcattcacaatgaattcatacatcttcatataatcgctataagtttttatactttcaattgttgcatctgagctatctgtcggattaaattctgaaactgtagcagtactttctgaacttgttggggtttccgtagttttagaggaagattctactacctcatcactaatatctacgctatttaagatctgttcaaactcttgtttcctagtggaagaatagtcatcctttgacatataaattacatttaaaaatccctgttggagtgtcgactaaaaagagttgacctttatatgcttcgccatctatcgtacctgtcgcatcataaaggaagctgtccatcccatcaatcttagctgagctttcgttagctggtatcacttttcctgactgttccatccccttcagatattgggagcgaacagttgcatctttaactgattcctctaagggcaaccaatatgccattgccaatgatgaatcatcgggataaaaatataaggtatcactcgtatccccttctttactcttccatgattcatttatgctgatagccacttctgacaattggtaagttttgtatcttatagagcttgtacttacctgttctgtcgaagattggccaccgctagagctcgtaaggttcttaatcagaccaatcgcaaacaatccaaccaacacaataaaccaaattcgcttgtaaaatggtttcttttgcacatagacattcccatgttcatctctaattttcttcgccatataatcctccaaaaaattgtgtacaacaccattatatatatatatgcgttgtcaagtagaaaaacaaaaaaattagaagttttacctcctaattttcatgtattatcttaatcttcaatttcttttctgggattgacagctcctacgatgtaatcctgtaccaagcctgtaccatccagcacgatcccatgcaaaactccgccgtaaacagctccaccgtcaatccccattttcccatctggactggtccagatttggctaatgcggagttttgtttgataaaggttataaacaggagtatgcccaaagacaatcatcttccctgtggtattttcggcctcatggaaaggggtgcgtaaccaaaccttatcatgattgctggtttcacgccagtctggtaaggtcaagtccacaccagcatggacaaagatataatcttccgtttccagatgatagggacaagatttgacgaaatcaatcaggtcctcatattgttccaacactgcattggcatccaccaatccatctacaggagcatccaagggccgaccaagaagggagttaatcgtcgtatcgccaccatttcgccgatagtggtcatagcggtcaatcggatcacgcaaccaggctagaaacattcgctcgtggttacccgtcagacaaattgcccccttttcccgcaccaagctccagaccaactccaaacaggctttggaattttctccgcgatcaatcaaatcacctaggaagatcaactgttgtcgcttctcgttccatttcttcaaaatatcgagtagcagttcaaactttccatggacatcgccgattacaaaaaattcttttttcatagactctattctaccacatttaataagcaaagaaaaactgaccgtttccgatcagtttggttttcttacaaacgtgcgttcaattctgcaccgagttcttcaaatcctggttttccaagaagagcgaacatgtttttcttgtaggcttctacacctggttggtcaaatgggttgattgcattgaggtaaccagagatcgcaattgccaactcgaagaagtagaaggtgtaaccaagtgtgaactcatcttgttgcggaagagtgacaaacatgtttggtacgccaccatctgtgtgggcaagaagtacgccgtccgttgcttttttgtttacaaagtcaacgtcttttccttgcaagtagccaagaccgtcaaggtcttctgccatttcaggaatcaagatattttttcttggtttatcaacacgaactactgtttcaaagatattgcggtttccttcttggataaattgtccaagtgagtgcaagtctgttgagaagttagcggatgttgggttgatacctttttggtccttaccttctgactcgcccgccaattgtttccaccactcgctgaagtattggagtgatggctcgtagttagccaagatttctgttacatagccttttctgtaaaggatgttacggacagctgcatattggtatgcttggttttcagcaatcttatcagatgtaaatgtcgtgcgggctgcgtttgcaccttccataagggcatcaatgtctgcaccagctgccgcgattggcaaaagaccaactgcagtcaagactgagaaacgaccgccgacatcatctggaactacaaaagtttcccaaccatttgcgtccgcttcaaccttaactgcaccttttgccttgtcagttgtcgcatagatacgcttgttggcttcttcttgaccgtatttcttgacaagtaattctttgaagacgcggaaggcaatagcaggttcagttgttgtacctgattttgaaatcacgttaactgagaaatccttatcagcaacataatccaccaagtcagcaagatagcttgatgagatagagtttccagcgtaaaggatttgtggagctttgcgctcttcacgtgtttgcaagtttacaaaggcattgctcaagaaatcaatagctgctttagcaccaaggtaagaaccaccgataccgataactaccaaaacttcactttcattttggattttagctgctgcttccttgatacgagcaaactcttctttgtcgtagttttctggcaaatccaaccagccgataaagtcgctaccaggacctgttccttgacggagcatttggtctgcaagggtaacttgtggttgcatgtattctacttcttgagctccaacgaattggcccaagacttttgaataatcaaatgtaatatgtgtcatgtttttcctccatttatgtaccataatatgataacgctttatcatatttttttcaagaaatttatcaattttcatttattttcatgaaatatgttgtataaatcttaatttttgtgaaaatctaacgaaattttcgcgtttgtaataatcctccaaagtctctcccgactgggttactgtaatccatttcgggagaatcttagatagtaggtaaagcggaatgagggcaggataccaaatgaacatgacttcaaagatgaaccggtcgttgttgcctcttgaaatgtaacgttggcggtattcttctttgagagaagggtggggaatatagatatgaaatggtacaccaccgcgtatagacatggccagcaacattctcatcagaaaattcagcgctactaggactgtctttccttgtctatgaagagtgtagcccttattgacatagattgttttatagcgtttatccttcagtgggcgtttggtggattttcgctcctctttcgttaaatgacgaacactgctattatcgtacttaatgtcagacatttctaagtccacaacatctgtatatttcttagcaagtgtcgtttttcccatacctggaaaggcaaataaaaacataggctttcctccttattcctcagtagaatagcagagcatccaaaaagttttcttaagttgcccctattttgcctctcatttctaaaaataagccaaagaaaaccctctgaaagcctgatttcaaagggttcttagattatacgcaaaaagagcacacactcgacctcgcttagggctgctggattcctcccctgacccgcttcacgcacgaatgttgctccatttaatattataacacaatttggccagagtgcaagtttggaatattaactagctatccgaagttgcttcctcttgcgtcttcatgataagtttagcagccttctgactttctctgcgttgtctgaaaaaatcttgcatgatattggcacattccgcttctaaaatacctgtttctaccttgacacgatggttgagccgctcatctgtcagaatgtcatagaggctacctgcagctccaaactttttgttggttgctccatagatgacctgcggaatgcgtgctaggccaatagctccgctacacatcacacaaggttcaatcgtcacaaaaagggtcgaatcaagcaagcgccaattcccctcaacattgttagcctcttggattgccataacctcagcgtgcatgattgcctgattgagttcctcacgcgcattatgccctctgccaataatctggccatccttgacaatcacacaaccaattggaatttcatccttttctagcgactttctagcttcttgcaatgcttgagtcataaaatactctttttcttcatgtgtatagttcataaatctattatagcacagccctgataacagttcaaaatcacttctttattcgctgctatcaaaatcaatctaacactacttcttccttatcacacatttctttcaaaattctgcccttctattaacttaaaaatataaaaatacctcctcagtcgagaaggtagggggagcaatattgatttttacagatattaatatatcatttattgtcgatattgtcaagaaaatttttaaaaaaattcaaaaacagcctcgaaaggctgtatctgacattttctattacaattcgccaactaatttcacaacattttctactgtgaagccgtagttgtcaataactgtttgggctggagctgaggcaccgaatgtgtcgataccaaggactttaccgtcaagaccgacatacttgtaccaactttgagttgcacccatttcaattgccaaacgacgacggatggcatttggaaggatttcttccttgtaagctgcgtcttgtgcatcgaagagttcagttgatggcacagaaaccacacgaaccttagtgcctgctgcttctaattctttggcagctttgacagccaagttcacttctgaaccagatgcaagaaggattgtatcaaagcctgctgcttcatagacaacataagccccttttgcaaccttgtcaaagtctgttccttcttcaactgtcaagttttgacgagtgagaacaagggctgatggtgtagacttgctagtcaatgacaagtaccaagctgcctgtgtttcacgcgcatctgctggacggaaaacgttgaggtttggcatagcacgaagtcctgccaagtgctcgattggttcgtgagttggtccatcttcaccaactgcgatagagtcatgagtgaagacataagtcacaggaagtccttgaagagctgacaaacgaactgctgcttttacatagtctgagaagacgaagaaggtaccaccatagacacgaagtccgccgtgggctgccataccattcaagatagttcccatggcaaattcacgcacaccgaactgaatattgcggttgagtggatttactgaatcttgcaaaccatcttccttgatgtaggtcatgtttgagtgagccaagtcagctgaaccaccgaggaaggttggcaagaccttagccgctgcgttaagcgcatcttgtgatgagttacgagttgcttgtgagaagccattctcataaactgggaagtcttctggcttgatttcaactacgtcacgaccttccaagatagctgttacttcagctgctaattctggatgagctactttgtagtcttcaactaatttcacccaagcatcgtaggctgctgcaccgcgatcagctacattagctttgaagtccgcatagacttcagctggaatttcaaatggaccatagttccaatcaagcgccttacgagttgcttctgtttcttctgcaccaagtggagcaccgtgaacggcatttgtaccttgtttgtttggcgaaccatgaccgataacagtcttgatttcgataagagatggcttaccagctacttttgccttttcaatagcagcaaagatggcatctacatctgtaccgtctgttacaaggtctgtatgccagccataagcattgtaacgggcacgtacatcttctgtgaaggagtcttttgtttcgccatccaagttgatgtcatttgaatcgtaaagaacgatgagtttttctaatttttgaagacctgcgtaagaagccgcttctgcagaaacaccctccatcaagtcgccatcaccacagattacgtaagtatagtggtcaaagattgggaaaccatcacggttgtacttagctgcaaggaaacgctctgcttgcgcaaaacctgtcgcagttgagataccttgtccaagaggacctgttgttgcatccacacctgctgtgtgaccgaattctgggtgacctggtgtttttgagccccactgacggaagtttttaatctcgtccatagtcacttcttcaaaacctgaaaggtgaagaagtccgtaaagcagcattgacccatgacctgctgataagataaagcggtcacggttcacccagtttggctgagcagggttgatacgaagttctttagtaaaaaggctgtaggccattggagccgcacccatgacgacacctgggtgacctgattttgatttttcgatggcatcaataccaaggaaacgaatcgcattgactgaaagatttgacatgtttttctccttttttaaagtcatgaatttattataccataaagcgttttctatgtctgtttgaatgaagcgagaaataaattgtccgtagaaaagaggcaggactttcgtcccgcccttggagtgaacagtagtaattcgcacatttcatactttatcagagtttatagtgcctctcctcgtctctatggggcaagagagttctaaatcttataataaagccttaaattgaatatttgagtcttctaagaagcaatcatcaaagccacgtgggtggtgatattcgatacggtccttgtccatcgggtaagtatacttgccaccaacttcccagatgaatggatggaaatcgtattgcaagcgttctttccgcattttccagagctgtaggatttcatctgttgacgccatgaagttagaccagatgtcgtagtgaacagggatgattaccttagcacgcaagttttctgccatccggagaaggtcgattgatgtcatcttgtcttggataccgattgggttgtcaccgtagttgttgatagcaacgtcgatgttgaagtcacgaccgtgttttgcaaaatagtttgagaagtgggagtctgcaccatggtagatagttccgccaggtgtttcaaagacatagttgactgccttgcgagccatgagttcatctgtcacaggaagtcctgctaatttaccaccattttcgtcataaccttcgatcggaagtgtcaccaagcaagtacggtcgaaggattctacagcgtggaccttgatgtctttaaactcaaagctatcgcctggtgcgatacggatgatacggtcagctggaaccccccatttttcccagatatcgccactttcaaccggtccgacaaatttcacatggtccaatttaggattgttgatgatggcagcggcagtgctgatatccatgtggtcgctgtggacgtgcgatactagatagtagtccaattcattgatggcaaatggatcgataaccattggctgcacacgcaagtttggttgcaatttgcgcacgccagccatgttagccatctggtgtccccaaaccatatctttcacttttttagtggattttccacgtgatgaccagaggtccatgaccacgttagctccacctggtgttttaatccagacaccacagtttccaagccaccacatagcaaagttgccctctggcactacttcttcttcgatttcttcattgagccaagttccccactctgggaaggttgaaagaatccaggattctcttgtaatatcttgaactttagccattttccattcctcctataaggtacgtttctatgcttctagtatatgctccaaaggcaacaaaaaaaagaccaaataaaacacaggcttgtgttcaaacttggactttaccctaatacagatctgtttcaatatcttgactggataaattggttaataattcattggtaatcagtttttgtagccgttgtttgagttctcgagcggtccttccgtctgcgatatatcccgatagaagcttgtctagttctactgcaaaaacttgtttttcatctgccaaactacgatattttgcaaaatgagtcatgtttagcacatcatcaaaatctaaaatggggtgaacctgcaccaaagggaaatcagtttccaacccatcgctggttgtaatcaagaaatcaacctctagtaagtcttcgacactcttgaattgttcagtggtaaagactgcgccaatcttcttatctggcaagtgatgctggcattgtttataaagtaagcgttggactgacaccccttcatcacagattaaatagacaatctgtgtctgtgccttgcgtgtcccactgcgtcgaatagctcctcctagatgaatcgtcaaataggcaatatctccatcggataactcaatctgccactcctcctccaaaatctttccagaaacccgtgtcatagcaaacagggtgctgtatttatcttggatttgttggaccattggatttttagataggatgccgtaggtttttctgaacaacagagccttacaatgtgccaagagatgtttggctaattcgtcaggattttccaattcaaatggtgaatgtatctcaaaatgatgaataaatcgctctaccactcgcttcaagtcaatgaaatcttggctgaatacatgaacatcgctgtcctttcgataggatagaagtaaaatggcaatcagggagatttctatttcatccaatttcaaatcaaaggtttgcaacaaggcatctttcaattcctgagcaactcggtactcgatacgctctcgaacttgttcaaattctttgagaatggctcgttcttccaagtcatccagctccatattgcgatagctaaggagcaagaaaggcaatactttgagcataaactcgatttcgtagcgattgattttcttgcccagtttcttttctaactgcgatacttgtccctgtaaaaattgtgccatttcttctgagaagagcaactgacaccccaccaactcaaataacttagcttctagaacctgcaaaaaacctttattggcatccaagaagatggtatagagaagtgagtggacatattggattttatttaaagggtgacaaacgagactatagccatgactcttagacacatagagggtcatcttgtattgttcttgagccaactgggttcgaatttcattcaaatcatttaagaccgtattacgagagacttctgtcaactccattagccgttcaatggtcactctttctggtgtgatacagatatataccaacatcagctgaatgcgctcaggcatgctcatgacgtaggtgtacgaatcaatggaatcgagaagatctcgacaggctagtttttgcgcttcggtaagtcgaataccgaggcgaggtaagctttcaatactctctacagttgttggtagggcatcattgattttttctagatggtaatagatttttcgacgtgattgttgcaagcccttggaaatagccatgattgtctcaggttcctgtagaccaatcaggtacctcagtagagcgcaactactcttatctaataacaagattctcctcctctttcccccgtcccgttactatcttaacataattatctgggatattctaataattattaaaattcatctgattattacttgttttacattacataaatatttgtagttagaattaatagatgcttttaataatttctactcgggtaatcagttctccgtgcatgttatctatccgaagggcaacatttttcaaatatacacaggcaccaatagcaatggttttctcttcttcattgagttttcgtgtcacaaaatctctcaaagtctcactaccttcacttggaatttttactcgtgcgatgatattagccacttttactttctggctggcgcgcataataatattattagaatcatcaaactgagtgaagaggtattttctaactgcaaataggatggcgaccgaaataattccaatcaggtaatcactactagaaccatgctctacaatcagttggcgagcaatggcaaccaggagtacctcaatcacggtgctaggtgactgtttgcaaagcattttgataaattcgactccgaccgccaaggtcattgcacgactcagaaaattttgaataaacgtatccgcttgaatatcaccagctaatgagctgagtaggtctgcaaaaagaagcgttgacaaggctaaaagtgctaagccaagtatggcagataaaatcaattctaaatagtaggctgtttctgtcagactatcctgtaaaaatttcctcatctttctcctcatcaaaagggaaaaagcagttctccttttgggggagtctgctacttttccctactgtttttttcacacaagaacttaatgttcatcacccttttgtccatagtaggcatttggaccatgtttacggaggtagtgcttgtccatgatatagcttggtgctggctccacccttggattaatctgctcggtgtagcggttcatccgagctacttcctcaagaacaacgctgtggtagactgcctgagcaggattcttgccccaggtaaatggtccatggttacggacaacaattcctggtacagcaactgggtcgataccacggcgttcaaattcctcgatgatgactgaacctgtttctttttcataggccgagtttacttcctcagctgtcaaagaacgggcacatggtaccggaccatagaaatagtccgcatgagttgtcccataaaatggaatgtcacgacctgcctgagcccaaccaactgcttctgtcgaatgggtatggacaacagcgtggacatttggccaagccttgtagagggcaacgtgggtcgccaagtcagacgaaggattcaagtccccttccactacatttccgtccaagtcggtcaccaccatgttttccggtgacaatttttcatagtccacaccagagggcttgatgacgatgcgaccaagttctcggcagacttctgatacgttgccccaggtaaacttgacgagcccatgagcaggcagggcgatattggcttcatagacccgttgacgcatttcctgtaaatcttttggcattagtttaaccccgctttctcaatcaatggatagaggaaatcttgtgcctccttgatagctgctcgtgtttcctcaaccgtttcgcagttttcagaccacatctcaatcaagaatggaccttggtagttggtctttttcaagactgcaaacatattgtcccagtccacacagccctgaccaaatgggacatcacggaattgacccttggagttttcggttaccgcataggtatccttgaggtgaagggctgcgatagaacggtgtcccaggtaaaattcgctgtaaatgtcattatgccaagcagacacgtttccagtatctggatagacaaagagataaggcgagtcgatttctttttcaacggctaggtatttttcaattgagttgataaatggatcatccataatttcaatgcccaacatgacctgagcctgttctgcccagtcgcaagcctgacggagattcttgatgaaacgctctctagtttcaggtgatttttcctcgtagtaaacgtcgtagccagccaactggatgacacgaacgcccaaatcctgagccagttcgatacactgtttcatggtttctaaggacttggcttcaagagcagggtcattggagccaagcgggtagcgacggtgacctgagaaacaaatggtcggaatgcggacacctgtttcatagatggccttgaccaagtctaaacgctcttccttggtccattccaaacgagccaagcgtgcatcgctctcatctaccgacatttccacaaagtcgaaacctaattctttggcaaactccaaacgttccttccatgtgaagtgtttgggcgttgccttttcatatattccgattggtcgtgccataggtcttacccccagatacgacggatttcgtctttaaattcacgcgccgctgctgctgggtcggctgcttctgtgataccgcgacctgcgataaaggtgaagacatctacaccctcgaagagtttaagggtatcaacgtccaaaccaccagttacagaaacacggaagcccatgtcaaccaattttttcactttattgaggtctttttcgccccaagtttcgccagcaaggagggcgtcacgcgattggtggtaaatcgcttgggaaatacctgcgtccaaccagagttgagcctgttcataagtccagtcaccatagagttcgatttggatttcacccttatcaccacgcacttccttgatagccttcaaagcagctgccatagttggaatagttgctgaacaaatacaagtcatccagtccgcaccacgaacagcattgtttttagccacagtaccacccgcatccgcacacttggtatctgcaacgataattttgtcttggaagaggctacgtagcacttctaccaattcgctaccaacttgaagcaaacaaacggtacctgcctcgataacatccacttcatgaccaacggaaacagctgctttaatcgctccctgcaagtctgaatggtcaagggcaacttgtaaatttggaatatgtttcatgttttttctcctaactttctaaatctaaaccttctaggtaaggactgtttttggactcttccaccattgccaagacttcctcaggagtttgacaagcaatcaaacgctcaatcgaattttccaattcgaagagggcgataatttgtggaatagctacggatgtatgaatctttggatcggtagctgcaagagtgagcagaacagacacttctttcccatctgagaagacgactggttttgtcaaggtaatcaaagcaaaggaatccttcaagacgccgacacctgcttgggcgtgaggcatagccataccaggcatgagcacatagtaaggtccatattcttcagttgatgcgatgatcgcgtcgtagtattcctcagttgcagcaccactttcaatcagcggttcaacagccttgtgaacagcctcctgccaggtttccgctgtcaatcccaagcgaatggaattattttctgtaaatgatttttgtaaattcatagtttttcccttctacacgctatatgaaagggggagggaaactccctacccctaacggctatttatagcactgcttgtaattttgttttgatttcgttgtcgtccatgaggttgtcaagaccaaccaagtgacctttcgtgcgaccttccaactcagaaatcaagtggttagaggctacgacaatatcatatcctgccgctaaaccttttgcttcaccgactgagcaagaagctgattgaaaatctgttacgccgagttgacgaagggcgttttctaccttcatcttgatgaccatagatgagcccatgccgtttccgcaggctgttaaaactttaaccataatttcactcctattttatttttaatacattatgttctgattttacagaccaaggatactattctgcttgtgcctcgccacgatagtacgcttccttatcttttgctttcgcaaattgaagttgcggaatagccaataagaagaggcagacaagaacataaccagcaataccgaggtacttaaatgcaaatccaaatggtaaccatggcacttcaaagtcaatgtttccgtggtaaccaccgctcaattcaagcaagccaacgcagactgcaccaagagcaacttgaaggacacctgagatgaaggaaaggatggctgccgctttccaaccaccacgtttgtcagcgtacactgcgatagctgcgttatcgaagaatacaggtacgaaaccagtgatgatgaggattggactcttgaagacaatcaagagaacgattgtaatcaactgaccgattaaaccgaaggcaaaacctgaaagaactgcgttagatgaaccaaagccgtaagaagctgcaacgtccaccgctgggaatgaaccaggaagcaatttgcttgagataccttggaaggcatttgtcaattctgctacgaacatgcggacaccttgcatcaaaatgaagagatatactgagaaggtgaaggctgtttgaatcacatacataaagaaggcttgtttagctgggttgtatggagcacctgaagtgataacttctggatttgccatgatttctggacccaagatgaacaaaatcacaccgaagaatacaagcatcaatgtcgctgaagcaacaactgtatcgtggaagatgttgaggaagctaggtagcttcaagttatccaagttttcttcttttttaccaagttttggtgcaatcttatcgacaaaccagattgcgaattgttgttggtgaccgatggcaaatccaccgccacctatcaatcgttgggttggctcaactgtcatgtttgagctgactgcccagtagataccacagatgataccaatcgctgctgtaccgaattggttacgaagagccgggatgaggaagagcaccatcaatgagactgttgccgcttgttgtaccatgatgtgtccagtgatgaacagagtacgtactttggtaaccttacgtagtgccaccaagaggatgttgacaccgaaaccaatcaagagcgctgtagtggctgctgatacgaaatcagggaactcctcagcaattttcccatttgctgctgcaagaccgaagtaagggtcaataactgccgcatcaatttggaacttatagttcaaagccgccaaaatcggacggaaggttgtgaccaaaccaccggctgctacgttcaaaatcatatagccgactgtcgctttgataaaccctgcaaaaacatcatgaggctttttctttaagagggcatagcccaccaacactaaaagacctacgaagaaggctggattctgcaggatattctgtgagaaccagtttaatggggtttgaaggaaatccatttttcattctccttttttgaaatgatttttatggttttattataagttatgtaagcggaaacaaaaagaccaaataaagcacaggcttgtgttcactattggactatttccgaactttaatggctgatttaatcagaattcctccctatagttcaccagcccatttattctaataatcaataaatagacgttattttacctaaaaatttaaaagaagaggttggtttgaaaccaacctcttctagagggaagtgatactctcaactcttgtatttataagaaattcacaaggttttgagtaatgctcctctggagagccaaatattattactcttctgattttttagttcttccttgcgcagcaactgtcaaaccaagtccagcaagtccgagacctagaagtgccaaatcgctttgtcggtcacccgtaatcggcagactcgccttgcttgcaccacttgtcgcttgtccagacgcttgagctgttggagtagaaagacttggtttttctaccacatccttagcctccatactacccttaacaacaatccgcgcctcaccatctacaactgtttcagataacagatttgttgctactaccttgccgtcaaccaagacatcttgataaactaagactctcttacctgccttaccttcttgaagcacataagattgaccttttgcaagtgttgcatcatagcgaacttcctctgcaatcggaaggactgtttcttctgtacgttccttggtagtaaagtctagacttggtttttcttcagcagtaggcgctgtatctggaagcgccgtagtgatataaggcaaacgaatcactgttgcagtcaaaggtgcaagaacaactgagctatcagtcaattcgacacccactaaatcagacaatgcttctacacctgcacgttcaccgtcaaccagcacttgacccttaagcaattctttgtaaatatcagaaagaacaaagctgcgctccttactgtcggcgttgacaaaaacagcatagcggtccccattgcttgcaatggtttgataggcaatgaccacatcatttttagcaataccattttgacctggaattgaaatcaagctaaccttctgttcaacttcttcttttgttcccaaacggaaggcatctgtagatttgcgcaaggcaatcaatccttttgtaaaggcctgagtacgggtattctctggatagagcgcctcatctgtcgctttggtccagtcaaacttgttgaccgcatccgatgaatcgtaagaatcatgaatgtagtatggatagtcaaatggtgtaccatcagcatttgtcaacaaatgcgctttgttcggtaccttgtcctctgtaactggttccttataatcaggatggcggaactgtttggtccgtccatactcctgaccagaatgaataaacggtgtcccttgagcagtcaaaactagcaaattacccaagcgttgacgttggtgaatttcagtatagttttcagtaactgacggatccttcttgatggactgagcgataatatcaaagagggtcaagttatcatgcgcagcaatatactggatcacatcacctggatcatctgccaagaagttgcctggttgtgccttgatgttattgaagacagactcaacactcttagcaccgcctgtgataaaggctggctgaccttcgtttggataaccagatttaagtgtattgcgaatttcatctgagaataccgcaaccgtatctgttgaactcatccagtcttggtccgctggctgaacaggctgattagcatcacctgtaaaggttctccatccttcaccaagcataatgatgtttggattgagtttttgagcctcagtaaaggccagctcaattgcttcggcatcatggtcccccatcatatcgaagcggaaaccatctaccttaaactcatccacaagatacttgatggaatcaactaagacacgacggctcatgtagtgagtggtccccagacgaccaccaccaaagcttgatttagccgtaccatctgcctccatgaagtgataatagtttggctctaagtcttcaaataagaaggtcttagaagtgtggttatagaccacatccaaaatcacacccatgccttgtttgtggatttcattgaccagatttttgaactcttcgatacgtttcattggatctgtcggatctgtagaatacatacctgtaaaggcaaagtagctctgtggatcataaccccagttgtagttactgttgcttgacgcgtactcactcatccgctctgcatttttcaattcattgacaaaatagtagctcataacaggcaataattgaatatgagtcacacccaattccttgaggtagctgagacgctctgcaaaggcagcaaaggtaccaaactgagcagtcaattcatcggaaatagcaggatcggctgtgaagtcacggacatgagcctcatagataatagcatcttcacgctgattgaagttaggaattgtggcatagttcaaatcacttggaccaacttctgctgggtccacaatcgcagcttttgcaatccgataagatggatctgtatctgccaaatcactattccactccgctaaagatttagcatatgggtctaaaacaagaacagattgatccccacgagtgatttcataatggtagtagtaaccacgatagtccgcgataccaagacctgattggctgttcaattcgaggtcccattgtcccttatcccccttggtcatggccaatttaccgaccaccttagattgatcatccttatcataaagaacgactgccacactgtctgcacttggagaccagagagtcatatcaacgacactaccagcctgacgcacacgcgcaccaagctctccatcataagcatagagctcatccttcaactgccagctcatagttgttgtgaagctatcattgccatatttgagggtatagcccgcattttcttggttgaaatccccgaggactcgcaccttgttgctggtaaggtccaagacaaggtccgtcactgcaactgtctgaccattcttatctgttacagacaatttctccaagatgctatccttatccgcaccttccaatgttgtaaaggctgcttctaaggctgttaggctaacgtgagaaacacctgtcgcacggacattattgacaaaataagggttggtgtaaatagtcgcatcatcatccttgaggaagatttgtgtctgatttttcaaatctttaaagctataatctttctgctgaatcttcacatcgtctcctgacttgctttcatccaatagcaagaagccaatggaacttggtaaatctgtcaatttgacatcaatataggcaccgtacttgccttggttttcaaaatcaataccatttggccagtcacccagggtaaggtcagtcacatcaccccagatccagagacctttttgatcataattgccatcggtacggaagtaattgatacggatgtagccttctttaagtggttgatagaggctgagttgataattctcatcaaaccaagcttcattcatcttggtgctaatccgttcaatggtcttgtcacctgtgatgttatcaccagaagtgttattaatcaacagactaatcttgctggctgtttcatctttcatcttgatatcaagataatagccatagtcatcctgtttagccgtgctgaaattggttgcacctgttggccaagcaccaagatctgacgatggtttttcgacatcatcccatgtccataaacctaggctagataaattatcagatggtagagttttaaagtgaacacggaagtagcctgcttcaattggttcttcagttgctccttgcacacttgcattgacgatgtcacctgcttctgtctgaaggagcatggtgccaccttgaccgattgttggcagttcgacttgaacaacccatttaccgtctttctcgatagcttgataagattttcctgtataggcatctgtgacaactacatctttaccagatacttcaagcgccatttccttgttctcggtattggtcgagaagacaagataggcagcttgatcttggtaactgcgtttgctgataagccaaccttggctatcatttccagcaagtgtgcttgtatcaccacgtgagagcaatgttgaattggcattgcggaaagccaataatttctgatagtggtctgtgatgtcgctagtctctaccttgctccaatcgaaatcgtaccggttgtcataaactggccagttgttttgtccagattgccccacttcttcaccgtagtaaatgactggctgacctttagcagtaatcaaaagactagcagccaatttcagtttgtccagatttccttctttttctgcgccaccgagactgtagaggaaaccatcttcgtcgtgactgcccaagaattgacccagagaagctgcactagtcagaaccttgctacgttcttccagctcttttccagctgcttttagttgaccattgaccagatatttggcgatatccttgaagccaaagtccaacaaactatccatagtgccgatacccaagtcacccttggtatccttataattcgctccccaagtttccccaatcaagtggaagtcaggatctctatccaccaattcatttttgaaatgttgccatgtggtatcatcaacgtgtttgactgtatcgacacggaaagcatagatagagttgcccttggcagttgttgaacgttccaaccaagatgcctgccaagcaaccaactgattgcgaacagcagcttcttctgtcttgaagtctggtaatccagataatgagcctaattggtcatctccctgcttgtcttcttccttagtccgtaccatacctgcaaaggtttcttctgtaccatagccagcatggttaagcaccacgtcaacaataatattgatgcctttttcggctgcggcatcaatcaattcgtggaaatcagctaaacttcccaaatgcggatttagtttctcaaaattggatgcccaataaccatgataagcatagtattctccatcttttacgctaccaacattctgtggaatattttccacaatcggagtcaaccagatagagtccacacccaattctttcaagtagtccagcttggctgtcactcctttgaagtcaccgccctggtaaagaccgcgtgggttggaggctgttccttccactagcttgtcattgccggtgtctccattatagaaacggtctgtcatcatgaagtagatgacttgctcgtcccagtctttttcaccatctgccttgatacgctctgtaatggtcacatccaattttgtttcgtagtaaccgttgtccttgtcatagacctttacaggaagactatatgtccctggcgctgtgctagacgtcgctttaatggtcacacgattgagctcagtagagattggcacaagacctccaccgatggcacttgtatcgacttccattttgactatttcagcattttcagggttggtgacggttacagataccaagccactttcattgtagttgaatggtgctttcacacttgccccaacagtcacattttttgtacctggagtagctttacttgtatcgagttctactttctcttcgataaaatatggattggtatagactttgtcgtcgtcattgcgaaggaaaatttggctatgccgtttacgatctgcaaaggctaaatcaattgttttattgcctgccaaatctggattattctgattgattagcagaaatccaagcttggaatctaaaccattcgatagaggaatgtcaacataggcgccgtatttgccaagtttaaagtcaacggcacctgctggccagccgctacttgcttcagtcgtatctccccaagtccatacgccccaaccttcataattattgtcttcacgggtgtagttgatacggaggacattttcatctttgagtggctcataactagacacgctataatcactagcaatccaagcctcattttgttccggaacaagtagctccactttctggtccgattctgttattttttccccattcttgagaaccagataaccaatcgttcctggtgtctcagattttttaatatcaacgtaatggccgtagtcatctacctgactgcttgaaaagttcgctgtatccgttggccattgattaccatcggacggctctgccactcctccccaagtccaaagtccttgactttctggtgctgtttcatctacattttcaaagtgcagacgaatgctgccttcttcgataggagcttcctctggagcagttgcatcggctgtttctgttaccgctgtcgcttcagctaccatagaatctgtagcttctatcgcagttgtggtcgcttctaccgcgccgccatcctgttccgaaagagtcgttgaactagttgacgcagggaggacaacttcctctgcctgcactagttgacctgctccacttaaaaacagagcagccgcaatcccaacagaggctacacctacatttagtttacgaatgccaaaaatctgtttcttctctagcatccctgttcgtttcatattctgaacggatttctttttcatagactcctccatataaataagtttgaattgtacactaccagtatatacaattccaaggagtctttgcaaacgttttcttaaatgttaacggtaacaagttttgagctactatctaacaaaaatagaataaatagctcccccttcttttgctcctagaccgcccactgaccaaaaaaagagactactgaggtgtagtctccctttcaattaaggttgcctggcagtaatgcccctgtctagccagaggcttgccatccaatatcgtcattaaatgtttgacgctaagagcccccatttgacgaatcggctgcttcatcgtcgtcaaggctggtctggacatcctatctaaaaagaagccgtcaaaaccaatcaccccaacgtcattcggaatagactttcctagagcttgtaaacctcttgtaaccccaagagcgagacgatccgatgcgcagataaagcaggtgttttctggtaaataatcaagatttttcacaaattcttccgcaacacgagaacgattttccaatcgatagagatgagtttctcggccctgcatcgcatctttgtagccttcttctctccctttttcaaaggcttctggcaagtcaatccctacaaaaacaatcctctcataaccttttgataaagcaaactgggttgcggacctagtcgccaaacgattgtctgaatctacaaaaggaaggccttcttgattctccccaaataaaatcaatggcttccgcagccctttcaaccaagggtagtcatccttgcgagcgccagtcacaatgtaaccatcacattgatcagtgatctgacttggattggtcaccaactgcaaggtataatttcgatgattgagctcatcagcgattcctgcaagaaggtcgatatagtacggctctaccacatccatcttttcgagaatgacagcctgaacaatcagtgtccgttgctgggccaaggccttggccgccacatttggcttatagtttaattcttccatcgcagctgttacgagcgtccgcagctcttgtgtaacttgttctggatggttgatgacacgcgaaacagtcatctttgatacattggctaacctagccacatcggctaatgtcgtcatagaactcctccctaattctatttctgttgcttatcttttagcaagcaaacagtcaaaattgtgcaaacgttttctttaggttattatatactatttattactaaaaagtaaagacctttcgaatacatttatcgttatttagttttccttctattacttccttagctcaccttgcctaacttcatctatgcctgcggctcatcgcctcgtgctaaaagtactatataagaatacccattccctctaaacaaaaaatactccaactgctagaccaatcaatgtctaacaattgaagtatctttgtcaaattctgtccattttctgtacgattatggaaatgaataagataaattaatttgcttagcttactcaacatctaccttttgaatgcgagctaagaattgcttagtacgttcttcttttggctggtcaaaaatgtcttctggtcgaccttcttcgataatccgaccaccatccataaatatgactcgatcagctaccgcacgcgcaaagcccatttcatgagtcacaaccaccatggtcataccttcttttgccaactgcatcatgacagccaggacttcaccgattaactcaggatccaaggccgaggttggttcatcaaaatagatgacctcgggattggtcgcaatggctctggcaatgccgacccgttgctgctgaccaccggacagctgacttggatagaaaccatatttatcagatagtcccaccttgtccaaggctgctttaccgattctttcagcctcttgtttgggtactttccgagccacaatcaggccttccgtcacattttgtaaggcagtcttgttggcaaagagattatagttttgaaaaacgaaggctgtgcgcttgcgaatgcctgcaatttccttcttggtcatctgagccaggtcatagctgtcctcaccgaagactaagtgacccgcgtcagctttttccaaaaagtttaaagaacgaagaagagtcgtttttcccgatccagacgggcctaaaatgacgaccacctcacctggattgacctctacatcaatcccttttaacacctgctgaccaccgaaggtcagctttactccatttgcttgaatcatctgaacctcctaatagactgccaacttcttctcaccataggcttgaagcttggtcaaaatagttgaaaagaatagataaacaagggccacctcacaatagagggcaaacggttcgtaggtccttgctgcaatctgctgagttgccataaacatctccaaaacggtaatattggcagccagcgatgtatccttgaccaatccaatcaaagtattggacaagggcgggaaggccactcgaaaggcctgtgggagaataatccgacgcatggtctgagcaaaactcatcccgacagaatagccagcctccaactgccccttaggcacggactcgatagaagcccgtatggtttccgcagcgtaggcacctgtattgacagaaaaaaccaaaaccgccgacggaaaagcatccaagacaattcctagacttggtagcccaaagaatatcacatagagttgaaccaagagtggtgtccctcgaacaacccaaatatagaaacgagccacttgtttgagaatgggaatctgagcaatttgcaccaaggccgtcccaatagcaattaacaagccaaaggtaaaagacaggattgtcagtgggatagtcaccaacaatcctggaacaagtatttgtgaaaatgaatcaagcaatagttgccatactctctctgtcattgtttctcctgattacttagcttttgatacgtcttcaccaaagtatttgtttgaaatttcagctaattttccttcactagccaattctgccaaggctgcatcaatctctttcacaagatcttcatttccttttgcaactgggaaggctgttgtcgatacgtcatccgtcaaggtcacaaccttaatcggtgcatcagcatgttgtttcacataatccaagtacaccaagttgtcattgatggtagcatccacacgtcctgtatttaacaattcaactgcctgagagaatccatccacaccgacaacttctgcaccattttcacgagccaaatctgcccagttacttgtcaagctgttggcagattttttaccagataaatctgcaaagcttgtaatgtcagtattatctttttgcgtcaccaaggctccatagatgtatgtatatggtgttgaaaaatcgtattttgccttacgctcatctgtaataccgacttggttagcgatggtatcaaaacgggccgcatccaaacctgcaatcatggaatcccattctgtttcaacaaattccaccttaacacccaatttctcagcaacggcttcggctacttctacatcataaccgaccaatttcccgctctcatcgtggtaagagtaaggagcataggcaccttcagtaccgatttgaataacgccttcttccttaatttgtgccaagagggtttggtctgtactattcgatgtacctgcagatgaattgcaggctgctaacacgatacccgcaaacaataaacttgtaaacatagctattttcttcataattaaaacacactttctttttcagattttacaatagtatcatgaataacaatttccagccaatatattttttctatcggggacattaaaaattttaatcaagtatcggagcataaaaaaagacctactcggtctttatatctcatattaatttactccagctggtgggtaaatatagctgactgttccttcgctagtcgttgttggatcaaagaaacctcggacattacttgggtagtatactccaccatagtttgattccttaacttgaatgtgaccattagctgccacatctgttacataggcaacatgaccgtagcctccatctgtccatacagcaatagcgccaacttttggagtagttcccacttcatatccaagcgctgccgcactagctgcccaatctccaccattaccccaatagtttccaacccaaggagccatttctttggcaccccaagtacactgacccgctggataggtattagccgtatattccaaagcaacctctgacaccatattggtagccaaagcagcctttgcagcggcagcagctttctcagccacaattttttctgcagcagctttggctgctatttttgcagcttcaaccttttttgttaacgctgatactgtcggactatcgcttataactgtgtcatctgcactgacattcaccattcccaaccataaaagatttcctatgagggctgtaaacagtcccaatttgaattgtttttttatcatttgataactcataatatttgattccttcgtgtttttctgccctatctatcctaaaggataatccttgcagagagcttaaaggaatgtaacaaatattacagataacttgcaatctcttaacaatcacagtgtccggactttttgtcaaaaaaacgacctccaatacggaagtcgttttctatttagtgttagtgtaattattttctcctactcctgagtacactgattagaataaaaaccaaaccagatataatgtttagatatttattcccataaagcggactaatcgcgataaggaaaaatcctagcgccaataagaaaggagatttgttcttggaaaacattattcctcaccagccttaaccttattggctgcaataacaaatggtgtccaaatcaggaaggcaacaaagaggttgaatagtgaaaccaacgcagccataatgttaccacctgttgctagataagcgtagagtcctggaggggtaatccatggaacaggagcaaagactggcggaattatacctgccgctgtcgctaagtatgcgatagttgcacaaatcggtggaacaattagccatggaatagcaaacagtggattcaataccattggtataccaaaggtaactggttcgttaatattgaatacacccattggagcagataatttagctaccattttgtattcttctcgttttgagaaaatgaaaatagcaataatcaaagctagagtgacgcctgaaccacccatttgagcataagcatcaaaggaaccacgagtccaaagccacggtaaattcgcagtactatgagttgcagtataagcagccgcattttcatttagtgcaaccatatagactccgtccataattggcgccaagacattgtgaccatgcaggccgaagaaccaaaaaagttgtacaaggaaagttaaaagaatgactgacccaagaccttgtgacagaccaagtaatggcagttgaatataagttgatactaaatctcccaaagattgtcctgttagagtaaatgcaagatatgccacaatggatgacgcataaattgcagcagtacctgggataatagcagcaaaggccttattaactgccggtggaacagaatctggcaatttaataatgacattccgttttacaagacttgcatagacccatgtagcgagaaatccaataaacaatgctgtaaacaaacctgttgcaccgccatatttcaatgcgatagctccccactggcttgtttccaaggctgaaactccatctgtcgtcacaatggataatcccaaaccttccaaagcagaaacaactgacttatcaactccgtctaaagcagtggaaatcgttacactttgaggaatagtagagatgaatgatgcaaaggaaattaaaccacctgctaaaggattcaccttatacatgagtgacaaattgtaaccaaaggtaaaggcaaatacaagtgccattatcccgatagttccaaaataaacgtaaccattgatatctatcactggttgcatggcatcagcaaaaccagtccatcccatattatttgggatgtctctcagaaagacattcaatagaacggccactgtacctgccatcgtaatgggcatcatagaaataaaggaatcacgaatcgcaatcaaatgccgttgcgaaccaatttttccagatatttccatgaacttctcagaaatatttgacatattctgtctccttttctattttttgttttatatttcctaaatgttaaactgataccggctcaactgagcaacgaatcagcgcctctaactgggcatttgtctgacgttttatactttttgaaaagattttttccatgagaaattgattgccttttacaaaaatatcaccagcctccatctcataagaatattctatattggtttgatcattccctaaatcctctaactgatagcgaacatgctcttttcctcgattagaatggaaacaaactgcatagcaataaggagctgtaaactcttctacagttaccttgacactatgttgtcccttatcaccaaatgttttagtataagtaagtccctggataatgtcttgatcttgcaagatggaacccgtattttgctgaaaatcatcttttaaggattggcgaatagtagcgaaaagtcgctcaattggaacttgacctatttttgatatcttcataacccagttctcctataattatccaatctgtttataaagatctacgaactctttcgctaaatcaataaatgtcaaagcattcatcaagtgatcttgtccatgtaccattaacaaagataattcaacagactctccacttgcttcttttgctaataattgtgtttgcgatttatgggcaatattcaatgaagctattgcgtcttggagcagctgttccgcttcgtcaatacgaccttctttggctgcttgaatcgcctggctagcgaagccctttgcttcaccaccgtacatgattaaccccataatcgcttcaagatactctggagaattcatactacccctccatcatttttagggcagcctctagcaccttagctccgttcatcactccgtaatccatcatattgatagcatctaccttaatagttggctcaaattttgccttatagtcgttcaataggaattttacttgtggacctaagagtaatacatcaatctctttttgagcaacttcattatcggcttcagatactggaacagcccaaatagttgcttcaacccctgtttcttctgctgctttttgcatcttagttacaagcatacttgtagacatgcctgcgttacaaactaacataatgtgtttcataaaaaactcctcctacccctttctttgaatgaggggaataaaaatatcaattaattctttataatttggatgatgtaacaaacgttcttggagaactctatcttgaacaaaatcaaccagacaaggtgagatatacttcagaaatgcatttcgaccctttgacggtgacaataggaagacgaattgaacttgctttccatggccccaatccacagcattcttatatatccctacaacaatttgttctgaataactcatcggcaaggctggatgaggaaaggctaaccgattcccaaagacaaccggactgtaagattctcgtaaattcacttgttctataaagcgattaacaaaatcaggctcaatggattcgtccaaagaggttactagttgcttcaaggctacttctcgatcacaatcctcctcaagatagattattctatgtggagcaaatactgcttctgcaatctgcttagcctgacctacttccattagcacattttccccttggtcaggaataactggggtcgtttgctgtaaatgagatcgaatagcctcaatgtccttctctgataggaagacgctgacattgataaccggtgtcataaaaattagattcgacaagctaatggatgaaataatcaaatcaacatccttcagtcgttcctctgtaacttcataataactaaccgtatcaagaatttctaagctggatgaaaattctttctccaagcgattctttaacatcaatgcacttccaattccggtagcacagactaccaatactctggtcttcttaaatccctgatagcgttcaattgccgccatcacatgtaaggtaaggtaagcccactcatcatccgaaatcgaataccccattagttctggtatcgctgcaaatgccatttttgttaattcgaaagcctcaaaatattggtctttaatttcagcagttagaggatttcccagttgaatattattctccaaacgaatacgtaacggcatcaaatgggccagaactcctttgaatagctgctgatcctttgacaactctaggcctgttaaatgtgacaaatgtaaaagactattctccacattctgtctaaatatctcttccacctcaccatcttgatttggattccccgttagttttaccttaaggtgcaacgcaatgtaatttgcttcctctgacggtatcgtcacttgaaacgtttcttcgattcggtctataatccgttgtgccacaagatactcttgagacgactgaatacgctccggtatcgggaatcggtctagaccagacccgattttcaaccgttgtaaaagaagagcgatatggagcactagattctgcatgacaaaatccgataaacgtaatttagcatcccgacactcgtctaagacgattaacattaagtctgtgaaccgtatatctggcaatagattggtttcgacaaccccataaacagattgaacatttccctcatcaaaaaagtaatccataataaagtgacggatagcaggttcatccccctttagttcaattcctttacgtgtcacaaggagttctaattgataggggataaatagttttcgaatatccgccaaaatggaatgaagcgtagtctttccaatgaatagctctctttgtaaacaatctggtgactgaatcggatcctcaaacaagagcttattgagaatataccgttgccgatcccccgcttcttctagttgagttaaatcagttaaccgcttttttaggagcaattgctcctgccaaaacatttcaaactcaactggccgttcaatctgtaaacaataaccactaccttgttttgaaaggatatgagcaccgctattttctaaagaagatgtcagttgatgaatatacgttcttaccgttcgatcactcactgataataccttggctagttcgatgcttggtacgaatgtctcctgttttgcaagtaaagcctctaacaagcgtacttcttttttagataacatgctccctcctttcctccaacagtctttgatttcttatatgtacattataacatgaaagcgatttctggaggtgcctactttttccgcatcattaatgaaagtgctcggaagctatgaccagtttaaactcttgccacggtttaataaagcgtaacaagggaagatagtctgggctgattcgtccgaccttatttacctttggactgatggtaaattctttgagtgcaatttgcaattcacccttgtagcgaccatataaatcattatcaattaagatatcacctcgtcccacaggaattgcttggtctgaccgagccggtacagatgcgtccttatacaccacacggggcatggttgaacgcagaacataagcagaaatatcacctctataaacatgattaaacgctacaatctctctttcaacgggagtcaaaccctcctcaatatcaaccatgaggctgattgtatcttcatttaaaactgtttgaatggattgtagttcctcctccgagataaattggtttgaaatcaaaatagaatcaataaaacccgttgccttcatccaagcaatttgcaagggaagaggccagaaccgatgatcttctaaagttggtaggccttcagataatggccacggtccttcagaagctgtttgtgcactgacaaatgccgcagttcttatacctgattgatgataaaaagatgacatctctaagaagtgctcttcggataaacctgtaaaagcatgaggataaaaattatggcaggcaataatattatccctgtttgcaacactagccaaaagattggacagcaagatcttatctgtactcaaattcaattcaacttttatgttgcgtggattatgtgtcatctcaatgatttcttccaaaggaagagcttcatcaagacgaatcccggccaaccccagttctgctgcacgctccatcaacgccccatcccaaccttgcgctgcgataaaatggggactgatatctgcaatgacagtcatccccagttgatttgcatagtcaattagtttttgatacaattcgaaaactgttcggtctccattttcaagttgcaacaaactcataaataagcgccttgctccgtattggtgcagaagtttaatgtaagcttgactctcttctagcgaatagttttcaggataaattgaaaagcccagttctaccatcattccctcctagcgatgaaaaccattagcatcgctcaatttcttgaaccacttgcctgatttcttaacaattctttcttgcgtgtctagatccagttcaactaatccatagcgattcttgtatgcatttaaccaagaccagcaatcaataaaggtccataacatgtatcctttacaattcgccccttcttggatagctcgatgtaattcaattaagtgatcttcgataaattcgatccggtaatcatcttgaatgagtccattgtctttaaatgcgcgctctccttcaactcccataccattttctgttacaaaccattcgatattatggtaattttccttaatatttatcgcaatatcgtatatccctttttcataaatctcccaacctctatgcggattcatttttttacctggcatatcatatggggcaaagaaatattccggagttagaggctctccctctttccaactattggttggagcttgtacccgaaggggttgataataattcacccctaggaagtccacacgattttccttaataatggctaattcctcatcgctgacctctggcattagaccatatgcatcaatcagctcgactaagtcatcgggatattctcctaacacagacggatctagaaagctctttgtttgaaacaattctgcaattcgagctgcttttatatcctctgcttgctcactacgagggtaggcaggagttagattcaagacaatagcgatttttttgtgaggatttacctcatggcatgcctttacagctaaagaacttgccaactgtgtatgataagccaccgcaactgccgcttttgcatcaaccttacatggataatgataatttcctagataaccacactctactggaacaatcggctcattaaaggtaatccaacgatcgactaaatcatcaaacaattcaaaacatgtacgtgcatatgcttcataggctcgaacaatttccttattttcccaaccacctttttcttgtaaacaatagggaagatcaaagtgataaagattgacaaagagctgaattccctttgctcttaccaaagaaaaaaccgaacgatagaaggacaccgcctcttgattaatttctccagtacctgttggtatgagacgcgaccattgaatggaagtccgaaatacagtgtgtccagtttcaactagtaaatcaatatctttttcataatgtttgtaaaatgttgatgtttgactagggccaattttgttatgaaatcgttcaggctcaatactataccaataatcccagttgttctgtccttttccatcacctggctcgattccttcactttgaggtcctgatgtagaagaaccccacaaaaaatttgttggaaattgataaaataccttgtctttagtcattgattgttccttctctcttttatgtgctgtatagctggtgcgaattgtggcaaatagttctcatgtgcaagtaacatatcttgtaatagcacttcagcttgtggtccatttgaaataagcgggttgagtgtaaaagcttgtaaagccagggaataatcacctgtcattgctgcctgaacagtgacaagctccatttgcttcatcagttgtaaatagccggttacaatcggcggagttggtggacaagctagtggagttgctccttgcgcagagataatcgaggtgacttctaccacacaattttcaggtagatagggaataactcctctatttacagtagatacggtcaattcttctctactatcattatggatagcacaaataatttgacaggcaacatcactatagtaggcacccccacgtagttccagttgttttggtttgtctttcaattgtgggtctttgtaaagctcaaacaattctgtctctacttcttgaacaaccttggctcgtacattaccctgacgatactgttccaaagcatcctctaacatttcttgttccaaaaaataataacgatggtaatcacatggcaacattccaatcgtccgaagcaattgaataggaaactctagattagtaatatttttgactgcttctggcatctcctctctcaaatccccatacaatgtttctaagattacttgcgtacgattttccccatacttatcccaaacttcatgaaagtgaaaatgatttaacccaatatggcgcgtacttaggtctccttctgattggcctaaaatctgagcagcaagtttcttttgaccaatagggatattacacaaaccaataactttcttccagtggagttcattagcaatggcttccgttacgataccagcaggattcgtaaaattaatcaaccaagcattcggacacaagtccttcatatccttgataatccctttatatgcttcaatggtcctaaatgctttaaagattcctccagccccattggtctcttgccccagcatcccataactcaagggaatggtctcatctaagtatcttgcaggtagttggccaactcggaactgagacgttacaaaatcagcctctatcaatgcttctcttctgtctaaggtcgactctatcttccagtccaggcctgcttttgcgaccattcgccgtgctaactcaactacgatctcctgtttttttgcgccttgttcaacatcaacaaaccaccattctcgaatgggtaattgatgtgcacgaagaatcataccttcaaccaattctggagtgtaacttgagcctccaccaattgtcactaatttaagagttttcaacacgctttccctccctcatcttcttttatattcttattatatttcagtgaacatctattgtaaacggatacacagaccctctttttccgtatcacaacggaaattaagacaacatgatcattctagaaaatacaaaaacgacctccaatacggaagtcgttttcttattatttacatttatttcacaacaatattaactagtttattcggaacactaatcaccttcaccactgtttgaccagctatttcagcttggactttttcatctgcaagggcaactttttcaagttcagctggtgctaagtctttggctacggtcaagcgagcttttaccttgcctttgatttggacaacgatttccacttcgctttctaccagcttgctttcgtcatatgttggccatgcgacatagctgattgactggcctgtatttgcaagaccctgccagagttcttctgccaagtgtggtgcaaatggggcgatcaattggacaaaacctttggcgtagtcaacataaagcttgtcttccttgttggctgcgttgacaaaaatcatgagctgggcgatagctgtgttgaatttcaggtcttcaatatgctctgtcaccgtcttcacagtttcattgtaaactttatcaagcgctccgctattttccgccacaagctccttagtggttaagaggcgatagacacggtcaaggaacttacggctgccttcgagaccttcttctgaccaagcgattgacgcatcaagtggacccatgaacatttcataaacacggagagtgtccgcaccgaattgctcgaccacatcatctgggttaaccacgtttttaagagacttagacatcttagcaggtgcctgctccaactcttcaccagtttccatgtggaagaaggacccatcgcgtttttcaactttatctgtcgctacaagggcaccacggctgtcgcggtagctagttcccaaaatcatcccttggttaaagagtttttggaatggctctttggtcggcacaacgccaaggtcgtaaaggaacttgtgccagaagcgagcgtagagcaggtgaaggactgcgtgctcagcaccaccgatgtagatgtccactggcaaccaagctttgagaagatcctcgtctgccaatttctcatcattgtgcgggtcgatatagcggaggtagtaccagctagaacccgcccattgtggcatagtgttggtttcacggcgacctttaacaccgtcttcacgcaccacttccaaccagtctgtcaagttagcaagaggtgactcccctgtacctgaaggcttgatgtctgaggtttttggcaataccaaaggtaactcattttctggtacggctgtggaagttccatcttcccagtggatgattggaattggctcaccccaataacgctggcggctgaagagccagtcgcggaggcggtaagaaatcttctcctgaccgacaccgttttcttccaaccaagctaccattttggcaatagcttcttccttgttaagaccatctaggaaatcagaattgatgtgggcaccgtcctctgtgtaaggagcttcttctacattgccaccttccagaactggaataatgtccaaaccaaactgtttggcaaattcccagtcacgctcgtcatgagcaggaacggccatgatagcacctgttccgtagcttgccagtacatagtcggcaatccagattggaatttctttaccgttgacagggttgatggcataagcacctgtccagacaccggtcttgtctttagccaggtcagtacgagccaggtctgatttgagagaggcttggcgtttgtattctgccacagcttctgcttgttcagctgatgtgatactatctaccaagtcatgctcaggggcaaggactgcgtaggtcgcaccgaaaagggtgtcaggacgggtagtaaagactgtgaagtccttatctgtgtccttaatcttgaaagtcacattggcacccgtagacttgccaatccagttgcgttgcatatccttgatagactctggccaatcaacttcttctaagtcattaagcaaacgctctgcataggccgttattttcaacatccattggcgcattggcttgcggacaactggataaccaccacgttcagacgttccgtcaggaaggacctcttcgttggcgatagctgttcccaattcttctacccagtttacaggcacttctgcctcataggctaggcctttttcatacaatttggtgaaaatccactgagtccacttgtagtagttagggtcagtcgtattaacctcgcggtcccagtcgtaagaaaagccaagggcgttaatctgacgtttgaagttggcaatattttccgccgtaaagtcagctgggtcattgcctgtatccatagcgtattgctcagctggcagaccaaaggcatcccaacccattgggtgaagaacgttgtaaccttgggcacgcttgtaacggctgagaatgtccgtcgccgtatagccctcagggtgaccaacgtgcaagcccgcaccagacggataagggaacatatctagggcataaaagtttggcttttctgcatctgttcctgtcttaaaagtatgattttttgcccaaaattcttgccatttgggctcgatttccttgtgattatagaagctcatgtcatttctccatgtcaataaattatctttactattatatcacgttttgggggaattgggaaagacaaaaacagccagttttcactagctgttttcccatttttaccaaataatcacacggtcttctttggcacgccacatgccgtcgccttcttgaacgccaaatgtttcatggaattcatcgaagtttggcaactggatgttggtgcgtaggtgacctggtgcatggacatcgacactagccaacatctgcatgaactcaggacgagccttcattcgccagatgcgagcaaagttagtgaagaattcctctgcggagaagtcatcttctgacttggctgcttctagggctgccgcaatcccaccaaggtcggcaatgttttctgacacggtcaatttaccattgattttggcaccgtaagaatcctgaccctcaaactggtcgatgacctgctgagtacgagcttcaaaggcagcatagtcttcctctgtccaccagttattaaggctaccatgctcatcaaaggaagcaccgtttgagtcaaaggcatgagaaatctcgtgggcaataaccgcaccgataccgccgtagttagctgatgaagactgctccagagagtagaaaggcgcctgcaaaatggccgctgggaagacaatcaagttcttctgtggattgtagtaggcgttgaccatgtgagctggcatgccccattccttaatgtccacaggcttgttccacttgctccaaccatgagcaatgtcaatcttgtttagttcgatggcattttccaccaaggacttgcttgggtcaacaagcttcttataataacgctctggcaaggcttctgggtaaccgatataaggcttgataacattgagtttgacaatggccttgtcacgcgtttcctgagccaaccagtctgccgtttccaaacgagatttgtaaacctcaatcatcttggcaactttggcttccacatcggccttggcttctggtgagaatttttctcctgcataccaaagaccgagggcttggttaaagtagccttgtgccaagttgtaggctgctttttcttggttttgcgcctgcggtgtaccagaaagagcacggctgtaggctcctgctagaatacggatttcatccgacaggaaggctgtataagctcctgccgctttcaagatcaaggtcgccttcaaaagctcccaattatccgcacagtaaatgtcctttgcagcctgccagaaacgttcctcaggcacgataatcttgtctggcgtttgacctaaaatcgctgtgaagaaatcatccaaaggcaactctggtgccaaggcagtaaaatctgcccactcgtaggggtgatagagttttgcatactcagaaccctcttcatttgacagaacatacttggcaatcgtggcatctagttccaaacgcttgtccaagaggtccttgatttcctcatcactgaaaccaaacttaggtaagagggcttcttggctctctctccacgttttgagcaactctgctcctttttcatgcccttcttcatagtaggtcgtatctggcaggataatgcctagagaatctgcccagaggacattggtggtcgcgtccataaagtcaggtgccacaccgaaaggcatgaggtttggcttgcctgccaactcatattctgccagcttgctggtaaattcttcgaaagagttgagagccttgtactctgcaatcaaggcctgggcaggttctgcacccaaacggtcacggatttcatagtcagctacttgtttgtgaaaagccacaaagttttgcaaaacgctatcttctgggacatcttctcccgccaaccaagcgtttgtcgtgtcaatcatgagcttttcaatctcatccgccaagtccgtgaaaccacctgttcttggcttatcatctggaatcacggctgtttttgcccattcaccattgacgtattcgtaaaaatcatcttgtaaacgtatcattgattttctcctttgtctttcttaatgactataataacaaaaaattctgacaatttcacttatcagatgaccgtgaccaagtattttttagaataatactcgaacaaaccacaagaaggctgacaacggcacaggtccctgacatggttaaatccagttgattggccactaaaaaacctagcacaaccgttagaatagcgataccttgccctaaaagaagcaattgccaaaaggatttgacccaacatagggcagccatacttggtgccaccaagaaaacaataacagtcatcgaaccaatcgcttcaaaggccagaacagtagttaaggaaactagaatcaaaataaccatttctaaaatccttgttcgtaagccagacaaacgagcatggttgctgtcaaataggtacacttgtaaacgatggtaagcccacgcaaaaaatagaacaataaccaaccaagccaaactcgacttgaccagactaacagggagtgaccaggctagaacatccatacgatggagcggagcaaaaagtacttccccctgcaaaaccagatccacatccaagtgaacattgcgagcaaaaagagaaataagtaaaaccgccaccgcaaaaaagaaagaaaaaactagacctgttgcggcatcatgcgctatctttcgactatgcagacggtcaatggcaagaaccgataataacccaaacagactggcaccaactattagcaatggcgaatccaaactatgactaataaaaaatcccagaacaatcccaagcaaaacagaatgcgatagcgcatctgccagcattgattgattttttacaaccagtatcgagccgagcaagccacaagaactagcaataaccatcaaaatgagtaatacttcaaacacgaccattctcctttctgacataggtaatatacacaaatgcagacagggtcagacctgtcagacagacgataatagtcggtccggtcgacaaaccagatacactggagctaatccaggtccctacgaaagccgacccaattgcaacgattcctgccagtaatagactcttgtgatacgattttcccagcatcaagccaaagacagctggtgcaatcaaaaaactactcatcaaaatagctccgactaactttaatcctactgcaattaggcaaatcatcaaaaacatcgtcaactgctgcaagtactttacacgaacaccaataacccttgcaaaagtttgatcaaacagatatagcttatagtcttgataaaagaaagcaaacaatgccaaagccaatagagaaataattccgatgagtatcacatcatccagctgaataaaggctgcctgtccaaatagataggtttgcaatccagcctgggaagcccctgcaaaggcttcatttccctgaatagcatttttcaagaccattcccaaaccaaagaaagaagcagacaccaatgaaagggcattgactaggctgtgacctccttttcgacgcagccaatggacaagtgcataagaaaggtaacctgacaacactgctcctaacagcaagtagagaggatgtcgcgactgaaaaatcatgaaagagacaatcactccaggataagaagcatgcccaagagcatccccaagcaaactctgtttagtaagaacagatatacttccgatagtgctggctgctacagctaggctgacggtccctaaagcaactgtccagaaagaatactctttgaaaacctcaaacatgactgcctcctttggcatttcctagaaacaacccatttcctatgccgtaggtcgcctgataattctcgcttgtcaaagtctcatccatcggaccagagtcaatcacatgcttatgaagccagacaaggtgatcaaagtaggcatccagcgtcgttaagtcatgatgaatgacaatggaagttttcccttcacattggaactccttgagcatatccatgatcatgatttctgttgcctgatcaatccctgctagaggctcatccataagatacaattctgcttcctgtgccagggctctcgctaaaaatacccgctgacgctgcccacctgaaagctgatcaatctgacgatggcgtaaatccgcaatttttaaccgttctagagcctgctcaacaatctgtctatcagccttagtcggtcttctaaacattcccttactatgagcgaagcgtcccatcagaacaatttcaaagactgttgcaggaaattgccaatttacttgactggattggggaatataggctactttttgagcaatcaacctctctagacctgcctcctgaccaagcaagcgaacctgccctgtgtcaggtttttccaaccccaaaatgaccttgaatagactggacttcccagcaccatttggtccaacaatagccgtccgactccctctgggaatcaccaaattgacatcttctaaagccatggtctggctggctgtatatgctaaattgacatcttttaattcaatgattgctgacatatttcctcctatttttaaaaatgatatgcctcattcatactcaatgaaaatcaaaaccagaccaacctaccaagctgagaaagtcgataagattaagataccgtaccaacaaattgctggcaaaccctatacatcgcttatttcaacacatcagtacatgaatttgattttcgcagagcaccaatgcttccttcaatcgtatgtttataaatctgttaaaaatggtccaaaaacggaaagaactcgacctagaccgagtcctttttactactcatttgaaatctctattcacgcacagactactgatatataaagtcccgctgtaaaccaagatcatcgaggtctacaagcggtatttctagtcaaggacctcaataactggtgtgatttgctactaacgcctatcctcccccaagcgttaccacctccaatagaaagagccctataccgcttgtgctcgaaacaattgattgtccctcatattggtacctatcaactctatctttggtaatatctctagtcttcattgaatagcaagtccgttcgacctgtactatttcagatatttaaccatcagtttaacattatgtttgtacatgtcgataaaggtatccccttcctcgccttctggtgccaaggaatctgagaacaactctttaccttcgccagtaacaacttcaacctgaccacctttggcttttactgcctcttgcaatttcttcatgcgttctggattggttgtagactctgtaaagatagccttgatattatggtcgatgattaggttaactgtctcaatcatgtcactgttagccacttctgagtcggtgctcacgccttgaggagcataaagagtgaagtcataactagcagcaaagtaattaaaggcatcatgtggtgttaccaaatagcgactttcttttggaatcacacttaattctttttctacccaggcatgcaaatcatctagctgcgcttggtatttttctgtatttttctgaatcatctcagctttagcaggtaagagtttttgtagttcctctgaagctacagctacagctgacttgtacaagggaattgaaaaccagaagtgcggatcgacaatctcttctccatcctcatccatcgtattcaagtcttttgcattaaagtttttagaaacagctactccggtcttctccaaagcttcaaccattttaccttcaaagtgcaaaccgtgatagagaacaaggtcagccttttgtaattttgataaatcactagatttggctacatacaaatgagggtcttctcctgctggaatcagcaaatcacgttccacctcatcacccgccaactgatagaccatgtcattgaggaaggaagtagtcacagccactcttggcttactagagccttctgtggtttgcgatggacgacaagctcctaaccctattagggacaatagcagagcaaaactgaacaatattttcttcatataggttctccttttatttttattaagcatacctaactatataattagattaatctaaaaaaatcattttgtcaactgatttttaaattttttgatataatagtttcagaagaaagcgagttctcatgacaccaaacaaagaagattacctaaaatgtatttatgaactgggtcaattagaccaaaaaattaccaataaactcatcgcagagaagatggccttctccgcaccagccgtttccgaaatgctcaaaaaaatggtagccgaagagctcatttctaaggatgccaaggcaggttatctcctcagtcaaactgcccttgaaatggtagccagcctctatcgcaaacaccgcttgattgaggtattcttagttgagcaacttggctactctccagaagaagtacatgaagaggctgagattttagaacacaccgtttcagatcactttatcaatcgcctagacctgctactggaacagcctcaaacttgtcctcacgggggaagcattcctcaagcaggacaaccgctcatcgaacgctaccagacacggctgtcacagctaactgagacagggaactaccagcttgtccgtatccatgacttctatcaactccttcagtacttggaacaacatgaattagctgtcggtgatttactaaccgtcacagccttcgaccagtttgcccagaccatcaccatccagtacaaggacaaagagctcgccgtcccaacagccatcgctcaacaattattcatcgaaaaaagcaatcgcccagcctaaacaagctgagcgattttttcttctaaaataaatagttacctctttttcaaattacggaaaatagatctggctgcaaaaaatagttgcccacatacatacaccaaccaaagtaggaaacctatataaaaacagcccaatagaaaatgagggttataggttaaaggctgcaagacaaacatgagaatccctaccaacccccaccgcataccccaggtcatctttctctggataatccactccagccaatcttctccaactgaacttctggtttccagatactcttgattaaggtcttgaaaaaattttctcatatttctgcccacctctgcacttgatagttagcaattataaaattgccaacttcctctcagtatacaggcatttccacaaaatgtctactgtcaatttttatccaccaatctgcaccaaaccaaataaaatttggaggaataaaatggaggcattatagaagctatgtgcaaggatagtatccgtcattcgtctattgcacatatacagatagcccagataagcccctgtgataaagtgacctaaaaatgccactgaaaagttccaggtatgacaataagcaaatagaagggcagaaaatacgatgaccatttgaggatgcttaggaaaatactgggctgtcttttctaacaaaattcctctgtaaagaaattcttctaaaactggagcaaacaagacaactgagagagccatcaccccaaaattgtccgaatttaactgattgactgtatccatggcgttagaatcactaaggctaagacccaaatactgccaaaagaggttcaggcaagtttgtccagtaaataccagtgctgtcattccgactatttttaaaacattcagcttctctcttgaaaagacttgatgcttcatcattcctcgtctgatgacagaaagtagtgccaatattggaagaccaagccctatcatgactgcaagttttagtagcacattctcttgaaaggctgttatccccacataagctggaaattgaatgagcaaagtgagcagcaaggtacccactgctaaaacgatggattttattattttcatattctctctcctttccattgtcatttataacctactcaattgtttttcacaatgttcacacctttaaacacttataacatttaaaatggtcacaatactgttcgacaagatatgtgccactatcggatatttgagatggttcgttttatagtaaatccaagaaaacaaaaatcctggaaaaagtgccgaccagaaactcaaagaaatttcataactatgtacaaaagcaaataaaactgctgtaattaacacgctaatatttaatggattcactacacaagaacgatgtgcctggtaaagtctttcatcagctttcgctatatccgatactttcccgtaaaactctgtctgacctgttttcgtttttaaaatgactttatgaatcgttgatgattttcaaaataaaggatgtcactaaaaggaacttgaatatgagcagtttcagttttgtatacaaaagaattttcagctacagtatgatcaatattttcaaaagcatgcactaagacatctgatactgccttttgaaagtcactatcctccaggcctttatctataaaatctaaagcagaaacctgataacgatatgttactggcataaattctgagtgagttgttacaaagacaataacagcataaggatctcgagcccggatttctttagcgatttccattcctttcttttcttctccttttatttcaatatctaaaaagaaaaattgatgattccctgcttcctcaattgattccaataattgatttggtttaccaaaaacttctaggaatttataccttactgacgtttcttcaacacactgcctaatagcattttctaacctgctctgctgaaaaaaatcatcttctaatacaaaaatattaagcattgctatctcctaaactttttgtaagttataatcattattatagcatatttagacaaaagataagtgtccaacttgacttggtagacctgccaatgtataataaacataggaaaaggtagttgctggaaacaactaccccttgcagaaccgtttaagacggtggcttgttataaattattaaaaaataaccgtgaactcgccaaagttatagacggttattttttttgtcgttttcaccaattcaagtactaacatcacgagagcgataacaaagttaccagctacaaacatgagtgttaagacctcaaaggttgacaaagatagcttctcctttctgttagattttgatgatttgcccatagacaccacctacctttcagaaattagagccaccgtctttacttttctgcaaaaactattatagcacagttaataaagaattgtagtccaatttacacatcaaaaaaccagcctacttgggctggtcttcttggagtcgctctcttaggcgacgacggtataaaatctgcgatggaatgaagtaaagaaaacttgccaaaataatccaacgtttatctattccactaaagtaaatcaccaaaatcaaaagaaaggcaatcgtcaaataaaagaaatgatttgtgagcaattttttcatagcatcctccatacctatttttcaatattagtatatcaaaatacacaaatagagtacataccattgccaaaagttttacttatttttcgtatccaaaacaatggtcaccggcccatcattgaccaggctaaccgccatatccgccccaaaaacgcccacttcaacaggcacaaaggctgacaaggcctggttaaaagcatcatagagttggctggctagggcaggagctgccgctcctgtaaaggcagggcgattgcctttttttgtatccgcaaaaagcgtaaattgggaaatggataaaatcttgcccgccacatcttgaacagacttgttcatcttgcctgcctcatctgaaaaaatccgcatattgacaattttacgaacagcatagtccaggtcttcctggctgtcatctggccccacaccgactaggagcaaaagcccttgttcaatttgcccatggatacttccttcgatggtcacactagcctgtgatacacgttgtaatacaattttcatcttatccgttggtccttttcactgagtaaacttctggcaccgacttgatcttgtccaccagactggtcaaggttgccaggttagaaatgccaaaggaaacgtggatggtcgcaaacttcatatccttggttggctgggcattgactgacgaaatattcttgctggcattggtcaaaaccttgaggacatcgttgagaagacctgagcggttgagaccgtaaatgtcaatgtttgccatgtattccttggtcgaattctcatcctcccagtccacatcaatcaagcgaacatcgtagttttcttgactcttgaggttcatacagtccacacggtggaccgctaccccacgccccttggtgatgtagccgacaatttcatcgccaggtactgggttacaacatttggcaatccgtatcagcaagcctgacgctccttcaatgaccacgccaccttcgtgacggattttcagactatctttgttgtcgtgtttgacttcgccaccgttgaccaattcatccgcgacagctttggccttagcccgctcagcttcgcgacgttctttctctgtcagacggttaaagattgatatggcagaaacttctctaaaaccaactgccgcaaaaagggattcgtcggtcttatagctggtcttttgcaggacctcatccatgtggcgacggtccaggtattggttgggaacgtagccattttcttggagtaggttctgaagcatctcacgcccttttgaaacagacaattccttgtcctgattcttgaagaactgcttgattttattgcgagccttgtgagttttaaccaagttgacccagtcacgacttggaccgaaagagttggcagaggtgatgatttccacctgatcgcctgtcttgagcttggtcgtcagaggcaccatacggccgttgaccttggcacctgtcgcccgctcgccgaccttggtatgaatctcataggcgaagtcaatcggtacggagtccttaggcaactcacgcactgcaccatctggcgtgaaaacgtaaatacgctctgtaaaaatatcgtccttgacagaatttacaaaggtttgcgcatccccagccccttcttggagttcaatcaggttgttaatccagcgcaactctttttcactagcagttgccttgccaccacgcttgtaggcccagtgagccgcaaccccgtactctgcaacctggtgcatttccatggtccgaatttggaactcgattggacctctcggtccgtaaaccgtggtatgaatagactggtagccgttagctttttggttggcaatgtagtccttgaagcgacctggcataggtttccacaattcatgaatataccctaacatagcatagacatcgctcggagtatccatgatacaacgaatggcaatcaagtcatatagttgatcaaaccgctttttcttatcgtgcattttgcgatagatagagtaaatatgcttgggtctaccgtaaatctgaccatgtagatggcgctcttctgtataatctcttagcttctcaacaacttcattgaccaactcttcccgttcacgacgcttctcactcatcattcgagtaatcttgtagaattcaatttcattgagatagcggaaagacatgtcttccaattcccacttgatagaagaaatacctagacggtgggcaagcggtgcatagatttccattgtttcacgtgaaatacgttcctgcttgtccttgcgcaagtgcttaagagtccgcatgttgtgaaggcggtctgccagtttaaccagaatgacccgcatgtcttgggacatggctatcagcatatttcggtggttttcagccaactgctcctcatgagacttatactcaaccttacccagtttggtcacaccgccgacaatatggcgaacctctggaccaaattcagcctccatatcatccaaagttacatccgtatcttcaaccacatcatgtaagaaaccacaggcaaccgtcacagcatccagcttgagtcctgctaaaatacctgctacctggatcgggtgtacaatatagggctcgcccgatttacgaaattgtgacttgtgtgcctctgtcgcaaaatccaaagctttcttgacaaatataacatcttcttccggtaaataggtggctgtcaaagcaaccacttcctccccagtgtagttaatttctttcatatctctactcttcctcttatatttcctactattctaccattttcacgaaaaaagaaaaaggaatctaacataagactactaattacaaacaatccaaaccaagttcagattcggtgaacgttcttgttttctttcgttttcttgttattttcactcgtttttcaaacgaacgttcagaattagtcttgaattttgcatttcttagctgtataatgattgtagaagattattacaaaaagaaaatggaggattcttatgaattttcgtttcagtaagtgtgccgtagcactcacactagctctcttagctgcaagcaatccaaaattagctcaagccgaagagattctcaacacaactccagcttcttcaacagaagcaagtcaggctgtaccagttgaatctgacaccacagaggaagctgataatacagaatctccggttccagccactaccgaagctgaaaatccaagctcttccgagacagctgaaactagtgatcctacaagcgagacaactgacacaactacttcagaagcacgcacggtcactcctgctgcaactgaaactagtcagcctgttgaaggacaaactgttgatgttcgcattctcgcaacaactgacctccatacgaacttggtcaactatgactattaccaagataaacctgtagagacactgggtctagcaaaaacagctgttcttatcgaagaagcaaaaaaagaaaatccaaatgtcgtattggtagataatggagacaccattcaaggtactcctcttggaaattacaagtctatcgttgatcctattgaagaaggtgaacaacatcctatgtacgccgccttagagactctgggatttgacgtcggcacacttggcaaccacgaatttaactacggccttgcctacctcgaaaaagtaattcgtacagccaacatgcctctagtcaacgccaatgtcctcgatccgactacgaaagactttctctacaccccttataccattgtgaaaaagacattcacagacaccgagggtaaaaaggttacactaaatgtcggtgttacagggattgttccccctcaaattctcaactgggacaaagcttatctagaaggaaaagtgattgttcgtgatgcagttgaagccgttcgcgatattatcccaaccatgcgagaaaatggcgcagacatcgttctggtcctttcccactcaggtatcggcgatgaccaatatgaagtcggcgaagaaaatgtcggttaccaaatcgccagcctgtcaggagttgatgcggttatcacaggtcactcccacgcagaattcccaggaactgccgaaaaaccaagcttctatgctaaatactctggcgtagatgatacaaatggtaaaatcaacggtactcctgtcaccatggcgggtaaatacggtgatcacctcggcgtcatcgacctcaatctggtctttaaagatggcaaatggacaactacttctagcaaagcggctattcgtaaaatcgatacaaaatcatctgtagcagatggtcgcatcatcgaccttgctaaagaagcccataacgaaaccatcaaatatgttcgtcaacaagtcggtgaaacaactgctccaatcaacagcttctttgcccttgttcaagatgatccatctgtacagattgttaacaatgcacagatttggtatgcaaaacaacagttggcgggtacttcagaagctaatctaccaatcctatctgcggctgcaccatttaaggctggtactcgaggcgatgcttcagcctatacagacattcctgctggcccaatcgccatcaagaacgtagcagacctttacctctacgacaacgttgtagccatcttaaaagtcaacggtgcccaactcaaagaatggttggaaatgtccgcagggcaattcaaccaagttgacctaagctcaacagagccacaaaacctagtcaacacagatttccgcacttacaattttgacgttattgacggagtaacttatcagtacgatattacgcaaccaaataaatacgatcgtgatggtaagatagtcaacgaaactgccagcagagttcggaatctgcaatacaatgggcaagatgtgacagctgatcaagaattcatcgtggtgaccaacaactaccgtgcaaacggtactttccctggggtccgcgaagcttctatcaaccgattgttgaacctggaaaaccgccaagccatcatcaattatattatcgctgagaaagttatcaatcctacagcagacaataactggacctttacagatagtatcaagggactcgacctccgcttcttgacagcagaccgtgcgaaatctctagttactgaccaagaatgtattgtctacctacaggcttcaactgccagcgaaggatttggcgaattcaaatttgtctacactgaatctaaagtagtgactccagatgaacagcagtcagatcaaggtaacacaggtcaagatattgtactcgaatctggtcaacgaattactcttccagcggtaaatccacctgctcctgctccacaacataaattggctagtccacattcacaagcgagcaccaagacactccctgcaacaggagaagctacttctatgcttagtctgctcggtctcactttgattggttttgtcggcgcatggactaagaaaaaagaacattaaaatagacgagactgagcaaaaactagcccttgttcaagcctcattgcttttgactcgtcacgaacctcttaatactcaatgaaaatcaaaagtagcctaggaaacgaagtcgaagatagaactggagttcatcaaggtaagttgacaacggataattttgtttttcgaagagtataaagaggcgttcgtacgacttgtcactataccaatacccttttgcactcaataaaaaaacacagatagactcaagctgattttgatgaaatccagctaagctgtctgtgtttttcttttgctcccattgttttggactaatttcttaaccaattttcgttaatactcaatgaaaataaaaatcagactaggcgacgcagatgcagatagaaccgaagttcatcaaatcaagttaacaatgtctgcttttgattttcgaaaagtataaattcatgctcactaggaggaagcctatctttgtttcaaccctcttttgacctctgcatacgccaaaaacacccttcatcctaccaaatataggttctaataaaacggtaaaggatataaagcaacaagacccaaccaaatatcgtcaggtaaaatacaagactgaatgaatattgctgaaactgctttatttcacgttgactggtctgactcacttcatcagcttcctctattacatctgattcgcgataagcgttgactaacaagcgataatcaaaaggaggaactagtggatcacatgtcaacaaggttaccatatcctgactctcaacaggtaataacttttgccaatctgttgcttttatcacttctgtattttttaccaaatacgtcagcgtcctcccaccaacctcaataaaaatcttatcgccttctctcaactctgacagtcggaaaaatctgagatcattgtaccaactacggtgaccggcaatgacacttcgtcgacctattccacctataggtaaagctgttcctataacagaagcaactccatcatttaaatgttcactggttgccccaacataaataggttgtcgaatttcaatttttggaatactcaaataaccaattgccccttccattaattcagaagataacacatcggtactatttgaatcatttttttctgcaaagggatcaactgtgggtaagtcaccaccactaacctgttccccataagccttaatttcttcgagttgctctgtcgaaaagaatttagaattcctacgataatactgatactgttggaaaacttgaaactcctgcactgacatatttgtcagcaacactaaaggaagcaacaaaccaaccaatatgaaaacatatcctattcttttcatcatttcatttcccccttttgatacttcttcctacggagaagatagaggataataacaatcactactatgattaatagggctaccaagtaggatagcgttagcatatccaaaaagaatgccggtttttgcttgattgcaactttcggttcataaggaacgcgatgtccacgtaccaacaaacgatggctgttaatcatataaggagtacaggttagcaaggttgcatagtcttttccgttttgaactataacaggatcaaaattattcggttcaacaactaaaatctggtccacctcataagccaatacctcagctatattatgaatgtagaattgatccccgacttttaaatgatcgagattggtaaatagcgaagcattaggaagaccacgatgcgccgtaatcacagtatgagtactttctccaccaactggcaaggaggaaccttccaaatgccccgctcctttttgtaatacttcctcagttgtcccagcgtatataggaattctctcgttgattttcggaatttctacaaaaccaattttctccttcacctcaagcatacgagcgtattccactaccccagccttctcttcttctgtgtaaggatcttgcaatttgtgaggttccaaggtctggttgtaggccctagcatgctccaaccttttcagaacttcttcactcggtaactgttgtgcttgttcataaaatgattggattttataatcagagtcataacgataataatattgagaaatccacggatatagcgtcactactaaaccaaagagaaataaaagcttcaagagtatggactgtttagatattccctttctaagttgtgaacgtttcatcattactcgtcactttctttttatttttccgcctttttgttaataagaaaatcagtaaaataccgacaaacattccgagcgcataaagaagataacgaataagaatacgcttctctgcattttcagacgctttaagatgctcttctgcaacataaggaatacgatgaccgcgtaccaataaacggtgcgtattcaccatgtaaggcgtacaggttagcaaggttgcatagtcctgcccaggcttgaccagcaattcctcaaattgagttggttcagcaaccactatttgatctacttcatacgctaatgtttctacgatattgtgaatgtagaaagtatcaccgatttttaccttcgttaagtctgtgaataaccgagctttgggtaaacctgtatgagccgttaagacagtatgggtatcgctccccccaatcggtaaggatgttccttccaaatgccctacacctttttgaagaacggtctcagaagttcctgcataaacaggaagcttgacctcaatttttggaatttcaacataacctatcttttcatgcaattccagcatccgtgcatactctacccgtccagcttcatgtcgtgatttggtatacggatcctccgaaaccacattgttcaaactctcattaaaagcttgagccaaatctattcgttccttaacctcctcagaagctaaggtcttcttttcttggtcgaaagaattagtcagctgatccgactcatatcgataataaaaattagaaacatgaggataaagtaaaatcccaaatccaatcaaaaataccaagtaaaaggggatattacttttcttttttttctttgtagtttttcccgattttttctgtatcataatccgaacttcattattcttccattgtctttctactgcattgcaaagttaatactcaatgaaaaaccaaaagtagcctgagaaacgaagccgaagacagaactggagttcatcaaggctagttgacaacggataattttgattttcgaagagtataaaatcccctacattctgcttttattataccataatccaactttaaaacgaaaaatcccattgccccagattcaacctgacaatgggattttccctctattctagtctgtcaaacgttatcgcttagtataagttaccaagcgataacctagcaagaagagcaaaataccggtagataaaactgcaatcaccaccacatttcctgtatatggaatttcaattccaggaggtgtaacaggtttattcttaatcttaataatctcggacacatgtgaatccgaggttatttcaaaaggaatcgtatcttgagataaaatgtagccagtaggggccttgacctcttttaagtagtaagtaccataaggaagaggacctaccacaaactgaccattcgaacttgacgtgacgtgataagaattgccgtcgactatcacttccttcaattctccgcctacttcctcaagaaccgcaaattctgccccagataaaggggcggtgctggttgatacctttaaaaatggcttgctacccttttcttcgctaggtctcctgaccttagcctcaatctttgtaacacctctacctacattcatcaagaatgggataacttctagactcgtaggctttcctacttgccgaacataataccatcccttagtcaatcctcgaaaagtggcttgaccttctggagaaagagcttgagaagaaattggctcaccatagagactggtcaactcagaccgacttttttgatataaagaatctgccaactgttcagaagaaacgggttcttctgaagcgatgtaccaagcctccaaacccgtcgaaacttgactggcatctattccattagggaaaggaatatgaacctgaacatcaaaagaatcttgtgcttggagtgaaagcgagggcaatgataatacacatattatagcgacaaggcaacatattatttgtcttactgttttcatctgcccctcctttctagtaataattaagcttcttcagattgacgctttttcatcgcgataaaggcaaataccatagtactcaaacctacaattgtgaaaacaagtgtaccgataccacccgtttgtggaatggttacttttttgtttttgatttgttggaagttatctgctgtcaatgcatctattgtaccccatgtatgtgctcctacagtgaattccacaggcgaagtagggagagcgaatccttctggagccttggtttcaataagttcatacttaccttctttaagacctttgacttcaaacttaccatctgttgatgatacaaatgtaaacgcaccttccttagtacctacccaagtccattgcatgttcatcttttcgtaagcagtgtcgcgagcatctttcttctgcttaatttcatcaattttaggattgtctgttgtggctgatttaacagtagctaaataatcagcttccgctgctttataatctgcgatttcttttgcttgtgttactgtatctttcaaagcaagatatgactcttcaccatctttacgaacgatgaactcagcacctagaagtttttcgctactgtccaaatccttatcatctgtcttcacaaatcgtttaccgtatgtgacaacttttggatcttctggtgtgagcggagttggatttggatttttcttgttttctattctgatagtacctgtatcaccatttgaatagctaggaagtgagcctgaaacgattgtttcttcaattacgatgtattctttagcaccatcaagaccagttaattttccagtattaacacctgctgcaagtttaatttcacctacacgtacaccagttcctttttcatatacaccgaatacaacttctgtttggtttacaccagtatcccatgttttgttaacaataatttcaccatcttttggagttgttgattttggctcagagaattcacttggacggttaccgtaaatcaattttacttggttagggatttcagtctctactttcgctgagtcatttaaagtagccttgtaagtcaaggtaaagttcacttcaccttctcttgctttttcttctaatttcgcaagaccgttattattcaatttcaccatgaatccacgtacagtttgtgtcaatgtgtagtctgtatctgctacaaaggttaagatttttattatctgcgatttgtagtgagtttagtttgaaatcaagacctgcaagcatggtatcttcccaagcaaatgtcttatatgctgcgtccttagggacttttgttgtaatagtgtaaccaatttcctgaccgatttcaacattttttataccatcttgatcaacatttgttctcttatcagtgaattctttggtgatttcaggtttgttttcagtattctttggatacacatgaagaggagttttggtatcaaagtatccagaaccatctgttttagcctgtggcaattcaagcttgaatggtacagctttcataccagtaagttcattctgattattgtagtaaggtgaattttctttatcttcagtgaagatataaatgccattagctagagtgaatgttgcaccgttatcttgtgtcattgcagttttatcggtttttacatacttatttgtatctccagtaataccaagttctgcacctgtcttagcttctggagctactacatctgtctttttccatacgtcaaattttactcccgcaacttccacggcagaattaccaaaataattcttcaaatctccgattgaattaccattatatttggataaattttcttcataagtaaatttattgaaatcgtcattattcattacgattttgtgaacaataacggttgtgctagccgtatcttcggcatggactaagtgtttaatatttatcagtgaaccgagcaccgttaggaacacagtaaacactgaaaataatttcgtcaattttttcattgtatactcctatttttatttcttattttatttacattaggaactatctagtatatttccgacgttgctcaacggcaaaagcaatgaacatcatcaccccccctaatgcaatatatggaatgatacccataccacctgttttcggatattctcctttgcggaggtttttcacaataatcaggtgattgtccatattgtctagactgacgaggtcctctccatcttggatagagatagccccatctgcgccaatattaatatggaattctttctcaatcttttgataaccgtcaggggctactatctctttcaagatataggttttccctactgctaaattgtcaaagaggacttcatcccctgttgtagtcgttgtttttacaactgctgtcgcttgaggattgtcactttctcttagttcaaacgttgctacaagacgttgcgtaggatcgctataagaccgtttagcaagtttgatatgggttgtttgttttgtattcttcatgttaaagagaataacattgtcaccatctaccctttcagctaaggtaacctgattatctccattatgaagtttggtcgttccatcatggtttatctggaaacggtatttcttaggatttaattgatatcccgttggcgcaacagtttcttccaaaatgtagtaaccaaaactcaaagatgtttcaaagagaccatttgtcgtcacaccactagcaacttcagtatcctcaacaccatcgttgtttggatcgctgtaaattttaaatgttgcaccatttagaaggtgattctcgtcacgattatctgttttttggagtctgaacttaaattgcttgaagttcttgatggtgatctcaaaggtagcaccttgtgacgtatcaactgtcaccatattcgaatctgactctaaaatttgtaaactaccatctggtcggatttcaaatttggtatcttgtaattgattaacagggcgatagcctcccgtaggaacaactgtctctttcaaaatatagacgccaactggcaagttcgagaaggtgatactgttgtcagcactatttgtatcccccttcatattaacaccatcaattacaactggatgaccagcctctgtaacaagttcaaagcgcgcatttaaaccaagagtcggatggtgataatcacgttttttgattttaagattgtacctacgctcgttatttttcactttaatgctaatcgcatttgcaagagcaccactaacaccaggtaaatctgttacactaaccgaattagtttgacttaaaactctaaaacgtgtcacagctttctgttgcgttaccgcataagcttgcgttgtttcgtataactccaacaataccggtgcactcaaaccgtcataaccttctggtgcttgtgtctctacaagaacatatttgccaagcgctgtcgcagttaatcgtgtcaaactgctttgacctgtaaatgttaaggtttgtacgagattggtatcgtcaagagaggtacttgatacagttgcctctgttgtactatcgtcaactttatagagcttaaaggtaacaggttttgagatttgcttattattcgcatctactttctcgattttgaactctggattttcgatgttaccgattttaataacattagcggcagcatcacttccacctgcttcaatcgtttgggtagcatctcgaacacttacctgcaattctcggattcccaaccatctattcgttcccgtctgtagattccgtacacgaatgtattgagcatagatatctacagtctgagtaaggtcggtctcggtgaaattaccaattgattgataggtgataccatccggtgaatactcaagggcatagctatccatcttgtcatggtcactaccgtttgtggtatttttaccttgagcaaagcgaatttgcgttacgcgctgaggcgaacccaagttcactccccaccattgtccctcattcaaagtcgaacttgggagttggtacaaggcaccggttgtcaaatcaccgtccagcgccttatcttctgtactagagccataggtagaggccatagcaatctctgcagattttatcacatgcaaaccacgtgctatgtgactacttatatccgagtcagaatagaaacgcacgctgccatctctattaacataaatcgtgtagttttctgtcgatttgacatagccagatggagcttgtgtttctgtcagagtatagaccccaggctggaggttttcaaaaacaaagtcttggtttgcagcttgctgtttgacgataggggcaaagtttacatcgtcattctttgtcaaagtaaaggtcatttgtccagtgataaggttggtcaaatcactaatccctttaacacgcttgctaactttgaattttccgagtggatagttcttgacttttatcgtaatcgtatctggcgagctcgtcgtcacatcaataccttcaagataatcactattcacttctacgataccatctgcccgaatagtgaatggtaccaaacctgataagccaatataacccgatggagttttttcttctttgatatagtaagttcctggggtaaagtttttaggaaagctaaattctccattgtcaaagtttgcaatttgcccatcaattacattcccttggctatccgtaataccaatacgtgtctgcacagttactttctgtccagtcagtgcatcaattttctgcactttaactttataagttggagggcggttaataatacgctcactagtaccagattcaaaactgatagttccagtctcagataccgtaaatcgtgccgcagctgttgttaacttactataacctgctggcgcactagtttcccaaagttcataggttataccaccttgcaagtggtccacacggagcttgccttgactatttgaagttaagcctgttagaactcgtttgtagcctgtttgggttatctgacgaagctcaaacactgcatctgcgagtggctgaccttgctcatttaccttggtgaactcagtactaaagtcctcgtcaacaacatttatactaaagtttccgttgacaacttctaccgctcccgtctgtgtattggaagtgtctgttaatttacgtacttttaactctccattttcctcataaacctcaatatcaagaggaggaatcgttttataacccgcaggagcttttgtctccgtcaaagtataaatgccttttgcgaggttagagaaaataaactgacttgcaggaagaacatctcctattgtgacatcataatttccaccatttttactttgcagtctaaagacagctcctttcaatggcttactttcaccaaattcaaatttattgatttgaagtgtagttgatttagtattaacaacttctgttggcttattgacatcgtattttttcccatcaatggtaatattttgattatcggttacaacaatagtgtgctctgtcggatctaagatataaccagatggtgcactagtttccttgaaggtgtaggtgccgccgattatctccgaaaactgaatatctccattatcatctgaaactgcggttcgatatggttcatttcctttatataatgtgaaaatcgcacctgaaagtggaattttctgaccatttttaattccaacctttttcagtttaaaaccataccaatctacaggataagcaccaccttgtgatactgtatctccctcacgacgatagatattagtggttcttcctccacccataactggactattccatggtacactcataccattatagtacagaccatttttctgaaactttttccgttcttttagacggactacaattgctttattacctagtttccaaccttcttgataaaattcgattgtatgagtgctttcaaatccatcaaaagccggataagaatttctctcagaataaactcgaacagatattccaatatccgtacctggtaggtaataatggtggatattcccattatttgatgttcctttataagtgagcttttctaagctatccttagaataggacatagccttggtaccatctgctacatagagttcgatagattgaggaatactatttgctacatttccatttggaaacaactctaaacctggatgaagaaaatcataaaattttctcctattacctagacctcttaatcaatgtctgattgcgagtagtcgttgtataccactcgggaaggtttggaagcacccctgttttatatagttctgtagtctctctattattgattttgatcacattactggttggaactccaatctcaaaccaaccattgtactcttgtacggaataagcctctgtagtcagtacaaagcgaattaaattatctttttcgtgataaacttttgctatcaccttaccatttgcagacacagtggaccatgcaacattaggatttgcaacatgacttaactttaactctggtggcaattctaaagtaaatgaatctcctgcacgcgcaaaagcaggtattttcaagttcattttcatcgaaccgtcaaaaccaccccaaattttagaacctgatttatacatgacatagttgatgcttacaaggtctatactgcttaccccatagtttccgcaagtatctggtgggaatactggtgtcgtggtattatcctttttatttgtaaagacatagtaaagattttcccagtcagtctgtgcgctagaaagaatataacctgatggaacagcttcggtcacatcataatatatcctctttttagttgctgtgcttctcataccagaaaacttatcaacattagcaatcgtaatttgtgtattatttgcgctaagtgtttccttacgattagttaaacttcctccattaaccgtaaaggtcacgtctaccttatcactatcagcctcccaattcttctggatttttatatcacctttcagcgcttctagttgtgctcctgaaatggtgtgattaactttttcgtctttcacatttgtcactgtcttaaccaaagcgaccgcacctgccggaacattgtcaaccgtaatctggttcccaggcgtagcaaccttttcagctttagtttcagtataagttccattacttggttcatatatataaaccttatattcatgggcagcttgtgagctatctagagcaacatcaaatgtaaaactttgggttgtcgacgtatcatttagttgtgaactagtccattcgatgaccttatcgtcattatcacgatacttaccaattgtacgattggtattggaagtattgaccgtatctacttttaagtcccctagaggaccaccatcatttttagctggaagcgtaatagtatctgctgttgataaggtacgtgtttccttctgagttaaggtaactgatgtgccattataggtaagcttgctgccctttggagcatcaacagttacttccgaccgataatccaaactatagttatcacttggaatcaccacaggagtctcaatcgtatagacatacgtcccgtttccaactggtaaattatcggtagctgacttaaaattgtcgaaatttccgtagtaagtcgtattgggcgttattgcaactccatccttcatgatagaagtaattttaggttcacccaaaccagagtcagttgttgttgagaaggcatttctaatggaggtgatattgctattgacaccgcctaccgtagtagtgtattcccaaatgatttttgttgtattggtatttgagtcaaccactacctcttttttcttcaagacaccatcttgtgaatagctttgataaacacctggaattgaaattgtaataggtttaaaaatgtattttatgtttgactcttcacgcgtgatggttgttgttttattcccgaatacggtggtcgttgtagtggcatttgcatttcctgtcacagtaggattatcaagtaatgaagtatcaagtagcgaacgtgctactctcgctgaacgcggtatcaaagatgaatccaatattgagttcagcataagtccttctaaaggatttttaggggagttgctaattgagacggtttgtcttgattgagctactgttaactccactacttcttttgtggcagaaatctcatagccatctatggtagatttttgaattaccgcatagtttcccaacggaagatttgaaatcgttaggagaccatctttatctgtctgaccagtataaacaagattttcactttctacattacgcacctcaaatgtagcaccttcgatggcttcattttcagtatcctcaatgccctcttcttgttcagaactagattttgttaatttgatacagataactcctcgttgttcgaccaaagcatccaccgcttgctctgactctggaactgttgaacttccttgtgattctggattatcaggtacattttcttttgtttcagagacgggtgggtcttgagaaggacttactacattgacatcctcagtagatgaaggcttttcattaacttgagaatactccttaaagacactcggttcagctttaaaatatgcgatatgttccgcatctactaccgctactaactcccccttaataacctcactgaccttggtaaaacttaaagtcagacttacattatctgccgaataatccaattctgttgttggcagcagtctataggaatggtagttttctccatacactggaagttcttctacagtctttgacaatacatctaattcatttgaaagagagcgtttttctgtctcactctttgttatagctaggtccttctcgttatatgactcatctagtttccaacctttttctaaatcatctttctttaactctagccctttttgagtgataactactatacctttttcgttaaaattctgtgtagctaaactctgcttatctattgttattttttgacctatagtctttggactagacaacgattctactaactcaatatttaatctatctttgtcctcctttttgtcttcgatataggtgcgtcttattgttgaagcaccatcggtcgacaaactttctgccatgatatacatcgcatctgtaaaactatacgtgcatagaaaaaaaactgacattaaactagctaattgaactgctttctttctaaattctatcatctcgtactccttggtttgtgtctaaatctgctaaagttgagatacagggacattatctttttcggttctaaatataaacaaaatcaactttaatacttattaagcttacatgaaattgatagttcaaataccattatttcaatgcactataatataaatagcaatcgccgtaagttccctgcaatcttcctctagttttcactttttacaataacacttacacagattttttccatatacaatcttacttgatttccctctaaaatcaagcgacattcagcgataaacacagaaaaaatagaaaaagaacatctggaaatgacaaaaatcaccttaatataaaaatgaccatatttcaaaaaatatgcatcacaccatattacatttcaaacactgactctctaatgagtctaggacaaaaagatttgtttttttgaaatacctcatctggtcattctaccgattgataaacaaaacaaaaaacgaacaatactagtttctagataccttaaaactaattttgttcgtttttatatacaaatttttaatttttctcaaaatcattaatagactaattttagattcgattgaataaaagatgtagcttaaatatttcggcgacgctatttctgttgccaaaaactcggatttgtgagctattatatataagtctgtcctaaattgtttttcttgataaagaattcccgaactacttaaaaaggactttttacctttttagcctaatatgcatgaagaaaaaattactcacaggcaatctagcacaaataatagcgcagctaggtaaaaagtacaacgccacttctttaagttagtgtcaatatctcagtgcagtagttgattgctctagcaatctgagagaattgcttgaggttagaaattgaacaaacaaagtttgtgccgagacagcccaagaaactgtttcagcctgaccctagaaatcaaaagtgaggtaaaaaagttggatataggatttgtaaaaaaaatcacagcaattcgtattttatagtcttttaatttacttttagtacgaggcaatgagccgcaggcataactgaagttaggcaaggcgagttaacgaagtaataaaagaaaaactaaatgacgatacactcaaaatctaccctaatcagctatgtaaggatgagaagacggactctactaggaatagtcgtcttctcatccttgcctggttcttaattccattattgaaaccaatcaccatttaactatctataccccaataatcaaaggattctaacaggttcaagaaagactcaaacattccccatcgtcagtcccgactgatgccgttctttcagtaaatggccaaaccaagatcctagcaaacctgctagggcaatggccaaggtatttataatcgtccctaaggcaaacatggactacctcaacaattccgtcgcataactaatggtcgaaagagcataaagcggagctgtttccgcccggagaatgcgaggacctaggcctgtcttgaccgctcctgctccttcgaaagcagctacttcctcaggcgacacgccaccttctggaccgacgatgacaaggactgattggccgatttctaagccagacaagattttcactagattggcttgttcaccttcttttgcagcctcttcgtaggctaagataatctggtcaaagcctgctagttgagctaggaaatccgattttttctcaaacaagcgaacagccggaatgcgattgcgtttgctttgctcggctgcgccttgggcaattttttctaacttttctgctttttttgccagttttttaccgtcccatttgaccactgaccagtccgctggaaaggcccagagggctgacatgcctaattccgttgccttttgggcgacaaattcgagcttatctccttttggaaagcccatggcaatggtcacggaaatgggtaattcgacattatctgtcagttcttcgatgatttcaacagactggctctggctatccaccacacgcgccaagcgtttaataccgtcgtcaaataccaaaacaatttggtcacctgcctgcaagcgcatgacagaaaacatgtgcttggcagtgtccttatcgctaatctggaacatgccctgcggtgctctgccattgacaaaatactgctgcatcctagcctccaatcacacctgagcggtcagccgtcttcttaaagacgcagcaattccactcgccctgggtcatgtgagtctcaaggaagaagccagccgcctccgcagatgctcgcaccatgtcccacttatccgcgatgatgccgctcataatcaggtagccctcgtccttgaccagacggtaggcgtcctcggtcagatggatgagaatatccgccaagatgttggcaacgatgacttctgctttaatgtcaatgccacgaagcaaatcgcccgctgcgacatgaatattgctagtattggcgttgaggtcgatattttcctgggctacacgcaccgccacctcatccaagtcataggcataaatctccttggcacctaggagggagctagcgatggaaaggacacctgaacctgtgccgacatcaatgactgtctcgccaccacgcaagacctgagaaagagcaaagaggctcatcttggtcgtcgggtgggttcctgtaccgaaagccatgcctggatccaagcggataatcttctccccagctgtcgcctcatagtccgtccaagacggcacaatggtcaaatcgtgggtaatgcgagctggctcatagtatttcttccagttgtccgcccagtcttcctctgccaattcttgactttctagactgatctgacctgtttccaagccaaagcccgtcaaatccgccaagcgagtcgccaagtctgccttaacttcctcaatatccacagtatcaggatagtaagccgtaatcgcaatcatatccgactgctccacctcgggatagagttcgccgaaacagtcttcctgtcccacatagtcagccgagtcgctaatggccaccccctgactgcccgtttcaatcatgagatttgaaactgcttcttctgcatcacgatgcacgtgaatcgttaattcttgccatgagttcatgtttgttttccttttcttttctatcgtcaatcactgtattattgtaccgatttctagcccattttacaagttaatattacgcgatggagccctaataatactttttcgaaaattttctaatcgcactgcgaataaacatgtgtaggaaagtttgaaacggtggttccaagtttctgaacggaggtgatgcccatgaaagtggacagcaaatctgctagggcacgcactagctcgagttttgaaaaatatcgtttcaaaactctcacgtcggaaatctctggatttatatttatcaggtctgcttgttgaaaggctgagcttgataatcgtcatcattttagctattcgagataaaaaataaccgtcagcaaactttgacacagttctgacggttatttaatctaacgaactgaaccaccgtttagcggtcctactgggcgttgagctggaactcaacgccttttctatttttataatagcaaaaatttcgcctgcagtcaagcaagagagaaaacagaatgtcaaatagaatctattaccctcaattctatacccactgcaccatactgttctaattgttctcgcgaataataaacttccatatcttctggtttcgcctctctgatactgctttgcgtatacccacaagacaataaatccagttctttgtataactgagcaaaattatcaaatatgtgaagctctaatacttgcacctcgatcgtttgcgtctgattttctgtacaataaaaacggatgcgatctccaatttgtatatgcttgcgcttctcgtcataaagtcgtagctcaatggtcttctgaccagacttcatcatttcaaaaggttttggagccagtaacatttcatgaaccatctcaatacctcggatatgggtaaaattccccttctaccaagtctgctttgcctttttcaaaagcctctccatcccaagaaatcgcaaattcttgggcttctgggtccgccaaaaagtccatgagatcatctaggccttggtctgcggtgtccttgagaaagcttgcgaaataggtcagaaattctgctgaaaagcccttcttggcgtcaaatggcagagcgaccagatagtcttcctcgtcaaagcgagacttgtcctggttgtagaaaaggacatactcctctaggaaaatatcctcagaagacgcattgccttcgtcgtccaccgtttcaatctcagccgcattttgtgcttccaagataaaagccaactcaatagcatgatttttcttgtcccagttgagctcgtaatcataagtaaaatgtttgtccagtgccgcttccagcacatctaaaaagccatgttttgccattctatttcctcttttctataaattccaataaatttatttctcgaccgtatttgacggaagcccgctcatctttctccaaaatggacttggttaaatctagttgatttaccgctgctaaggctacagcatagtgaataacatctgctaattcttctgccaaacgagcagagctgtcgtcttcgctatccatcatcttgcggcctgcacgttgattcagtagctctgctacttcaccgatttcttccactaatttcataaagagactttgctctggaactgtcgtcccatagtggtcacgcaagtattcttccaaaacactcactgtcaactccgtcatcttcgtttctctccaaatcctaaaattgtagtataatgattataccataaatgcactgaaaggaagcctatgccagccaatctcgcccttcgtatgcgacccaaatccattgatgaggtaatcggtcaggaacacctggtcggtcctggaaagattatccgtcgcatgatcgatgccaatatgctgtcgtccatgattctctacggtccgccagggattggcaagacctctatcgcctctgccattgctggcacaaccaagtatgcctttcggacctttaatgccacgaccgacaaccaaaaacgcctgcaggaaatcgctgaagaggctaagttttctggcggtctggttctcctgctcgatgaaatccaccgccttaacaagaccaagcaggatttcctgctccctcttttggaaaatggcaatatcatcatgattggagcaacgacggaaaatccatttttctctattttacccgccattcgcagtcgagtgcagatttttgaattacaacctttgcaaaccagccatatccgacaggccttggagttggctttgacagacagcgaacgtggttttgacttccctattaccattgagcctgaggctctggattttctggcaaatgcgaccaacggtgaccttcgtgccgcctacaattcgctagaactagctgtactttcgaccaaggaatgtgacgacggtagccgctacattgatctggacgccgtggaaaatagcctgcaaaagtcctacatcagcatggacaagaacggcgatgcccactacgacatcctctccgccctgcaaaaatccattcggggtagcgatgtcaatgccagcctccactacgccgctcgtttgattgaggccgaagatctgcctagtctggctcgtcgcttgacggtcattgcctacgaagacatcggcttggccaatccagaggctcagattcatacggtgacggcccttgaagccgcccagaaaattggctttccagaagcacggattttgattgccaatgtggtagtcgatttggctctttctcccaagtccaattctgcctatctggctatggatgcagctctggctgatttgcgaaagaacggtcatctgcccattccaaatcacctgcgagacggtcattatgctggtagtaaggagctgggaaatgccattggttaccagtatccccatgcctatcctgagaaatgggtggaccaacaatacctgcctgataagttacttcatgcggactacttcactgccaatgacaccggcaaatatgagcgtgccttgggcatgacacaagaaaagataaaaaatttgaaaaaaaatagacgccaaaatccttgatagaactggttttttggcacatacattttgacaccgcttacatttttgccatttttctcttgatttttcaaaaaaaagtggtattattaaatcataaataagaactgctgtggtatacgaattcatacctatgtgttgaccgactatttttgtattactagggagacaaagatcctctaacagtatgcaagctggcacacccagaagcaactaagttagaaacgcgtcacccacctgcttttagcgtgcgggatcaatacaatccatggataaccggtaccaatacagcatttttattttttaccttccttagctcagctggcagagcagcggactcttaatccgtgggtcgtaggttcgatccctacagggaggattggttgatatgaggaaagtcttgatttatcaaggctttttctcgtttttttgagtgaatttggtcaaaatttggtcaaaaagaaccttttcacattgtgaagggctatttttttaacttatcccacaggacaactcgtttttcctgtaatgatttctgtacatcgatgatgcgttgattcgatgagcctcgaaattgcagcataagattgcgcttggtacggtcataacggccgtcaactagaatatctaaataggatagtaactctaacttatccggagtttctaacatcatttcttcccatgtgtagcctgtccaagaccaaatgtccttttctggcagttctttccgaattcgctttacgagtgggaggaccgtgcccgtgttcagaaaaggctcgccacccaagagagttaggccctgtacatagggctgggccaagtctgctaaaatgcggtcttcaagctccttggtatagggaatcccagctttaaaagaccaggttgcaacattgtagcagccctcacagtgaaacagacagccactaacatatagagagcaacggactccttctccatccacaaagttaaaggctttgtagtccattattcgcccttggctaagttcctcgctcttccattcttgtggtttaggattattcatttcaaatacctgagcataagcaaatgaaatctgatcgtttggatgaattccgttttaccagtacacagactgtttttatccataaatggtacttccaatgctttagctcggattgatcccagcaagcttagtgcggaaccaatctcaattcctttcctgttttgattcagcagtttgtcactcccattaatcctcaatccagtatctttctactccgtctcgaacatcttccaaaacgccaccacaagccacaatcgtgcaacggctggcttgattgtctgtcaagcaagtcacaaggaccttggaaatatttttggttgcggcttcctgcaaaccaagtcgcagctggtccttggcatagccctttcctcgctcggttgggcgaatggaatatccgatatgaccgcctttattgagcaggaaatcgttgagccgtaggcgtagactgagaaaaccaagggctcgaccagtctggtcaaatgacacatattgaatggaaggaacaaaaccgtctggcagattgagacctgtctcatagtctttgtttctaaaaatccattcttcaaagtcgacatctttagagataaagcctccgtccatagctgagcctgctttttcaaattctgccagcatctccaaaatcgtttccttatccgctatagtcggtcttcttaattccattttagtctccatattgtcttttgaaaaattcactgatgatgtctatatccagtcccaagtcctgcacaatttctgccttgtggaaatcgtcatagttgtccttaccgctccaaacaaaagaattggtcacaatctgatagtccttatctgactcggctgctctgccattgaccacaaaaccctcactgcccgggacaatgccccacatctgagggtggagacctgtctgtatactggagagcaagtctctgcccttgatacgaactaagagtactcgcttggaaaagggcaagaccttgaccaagtccgaataaaagattggtcccgccgacaaggaagcccgaataccgaagccgttgatgaccgctccatccacctgcaaacctagttgactcgcctgttcaaataaagcctgacaaataacaggggccagagttgataacccttgacgaatgctgtctcgctctccgtctagtgcctgaggtaaaatcgctatcggttgggaaaaaactgcgtcacgttctgatttcatctggtcgataatagccttgaccgccctgtcttcttgggtcagtttctccacctcaatcaagtcataagccaggacctcgtgccgtccgtctgcataacaccgcagggatagatgaccgataaatctgccatattgcccagcctggcaaatactgacgctccctacttgagttggctctttcaagattgtatgagtatgcccacctaaaatcacgttgagttcagggaaatccttggccaaatgcacatcctcatcgtatcctagatgactgagtaagaccatatgagcctgtggatccttggcaagaacctgatccaccactcttcgtagagcttgtttatggccttcaaaaatcacattctccgacggtgacgcaacctcctgggtttccaaggtagtcaaaccgaggacatagagggggttcccattcatatcaaattcaaggacatcctcaagcagcaccaattcatcagccacctccacatcccgatagcggagattggaggacacaattggaaactgagcatagtcatccaagcgactaagcaactcatctccgtggtcaaactcatgattgcccaaggtcatagcctgacaaccaatttgattcatcagctcgatttccttgactcctcggtacatattgaaaaagatattacccgaaaagagatcgccgctgtcaaagacaaaggtcggaatacctttttgctcatttcgagctcgaatatccgcaatcagctgggctttctttggaaaattctccatgtaggaatgcatatcattggtatggagaatactaatatctgtatagtccatactattttttcttgttttttgcttgtttgagcaattcctgcacacgcgcttttttatcctgcttcacattagaattcttctcatgatagcgtgtcaccagggccttgcccttatcgtctaattgatattttcccattcttttcacctcattttcatttttgaacctgtgttcatttataacaaacttccacagctacctggaactgtggaagtcctatcttgtttatttatgatttacaaacttgacccgttcatgtgtttcacacgcgctgagatttccttgtgacggccttttaccatcggacgggcctgcggatttcctagatatccacaagttcgtttaacaacatccaccgacttaggatcgctattcccgcaatttgggcacttgaaaccacgctctgttggctcaaaatcaccttcaaaatcgcaggcgtaacaatggtcaatcggagtattggttcccaagtaaccaacacggtcataggcatagtcccaaacagcttccaaagcctttggattttgttgcagtacagggtattcacagtaatggataaatccaccactagcacctacagcaggataaattttctcaaaatccagtttttcaaacggtgttggatttttgcgtacatcatagtggaaactattagtgtaatactctttatccgtaatgtccttaacgatgccaaatttctctgtatccatacggcagaagcggtctgtcaggctttcagatggtgtcgaataaactgaaaaatgataaccatattcatccgaccaatcttcaaccaaggctttcattttcttgataatatccaccgtgaaatcttttgcctctgggttggtctcccattcgccaccgtaaaatacggttgcgacttcatacaaaccaatgtaccccaaagatacggttgctcgacgatttttaaagacttcatctactgcatctgtcttagccaaacgtttgccgaatgccccatattgatagagaattggagcattggccggggttgcctccttaacccgctccacgcggtaaaccaaggcatccttggcaatggccatacgttctgcaaagatttcccaaaacttatccttatctccagcagactccatggcaatccgtggcaaattgacggttacgacacccaagttcatccgaccagatgtcacatcctgtccattttcatccttccaaccttgaaggaaagagcggcaacccattggcaccttgaaggaacctgtcaactcaacaatcttgtcataagaaagcatatctggatacatacgcttggttgcacattcaatcgccaattgcttgatgtcatagtttggagaatctgactccaagttcaagccacgcttaactgtgaaaatcaacttaggaaagatagctgtccgcccttcgcgccccagacccttgatacgaatgttcaaaatcgctttttgaatttctcgctcaaaccatgatgtccctaggccaaaaccgagtgaggtgaagggtgtttgtccattggaagtaaaaagggtgttgatttcatactccaaagactgcatagcgtcatagatgtctttttgcgttttagcacgcgcatattcttcttgcttgtctgctaacacccaatcctcggcgtctttcaaatgcttttggtagttaagttccgcatagggcgccaaaacttcatcgatacggtcagctgagcagccaccatattgacttgaggccacattagcaatgatttgtgaaatctgagccgtagcagtttgaattgattttggactttctacatcggcatttcctatcttgaagccctgtgccaacatccctttaaaatcaatcaaacaacagttggtcattggtgtataagggctgtaatccaaatcatggtaatgaatatcgcctttttggtgggcattggccacatgagctggtaataatttgagaccgatagactttccgacaatacctgctgtcaggtcccgttgcgtattgaacacatccgcatccttattagcgttttcattgaccacagactggtccttgctcaacagcttatgaatttcaaaattaatatcggtagcctgatgacggcgaaaatcacggcgtgttcggtattgaatataaagctccgccaaatcatataaatgagcctttaacaattcctgttcaacgaccgtttgaatttcgtaaatttgaacatctttctcaaatcggcgaccaatttcagccaaaacagcttctaatacaatttttaaacctgcctctgaaacaggatgttctaattcttggtttgcccgctgaagagcagaaaaaatcttatcctggtcaaaggatactgtccgtccatcacgtttcaaaaccaataattctatactcggtaagacattttcttgcacattcatctgacaaacctccaaaattcttcacttctattagtgtagcacttcacaaaacaaaaatcaatatcttgtgtaaaaaaatattaaacaacctatccatgtactatatataggtcttaaaaattctatcaattggaaaacaactgtgcccaatttcaccactcgacaaggatgaattactagattgaaatatgaaaacagattgggcaaaggtctaacttctctatcagaaaacctaaaaaacagccctctaacagggctggctctatgtattgaaaataggctagggcgggtcacccaccaatgtcattaagttaactaacctatcacgttttgtggtaggttagttttttctatggtacactaaaaataaaaggggaaaagtcatgttagatcagattaaagctcacttacttgatagtattaacgacatcgtttccatcgcaaaccagtttgtgcttcatcctgaaaaagattttagtcggaaaagtcagctaactatggaaaccatgattcaagctatactgaccatgggtggtaataccttagccaaagagctacttgatttagatttgcccgtctctcaatctgcctttgtccaacgacggtatcagcttaaacatcaagcttttaaagccctgtttgccaatattacttctaagattccaacatttaaagatctccctatcttggctgttgatggtagtgatgtggttctaccaagaaatcgttctgataaaacaaccacgttccaaactggaccacaccacactccttacactctcattcatatcaatgctctttacaatcttgaacaagagatttatcatgaccttcgaattcagaataatcgggaggttgatgagcgtgcggctttcatcgacatgatggagagttgcccttttgaacaagctctggtgataatggatagggggtatgaatcctacaatgtcatggctcactgccaagaaagaaattggtcctatattattcgtattcgtgacgggaatcattctatgaaatcaggatttaacctccctgacaccccttgttttgatgaagagtttgacctaaacatctgtcgcaaacaaaccaatgtcatgaaagaactgtatcgagacttccctaatcagtatcattttttacctcataatgcttcctttgaccttttaccaaactctagtcgaaaaagtgatccaatcagtttttatgaccttcattttcggatggtgcgtctcgaaatcaagccaggtttctttgagactttggtgacaaatacggattattcaccagaaaaattaaaagatctctatgcctacagatggggcatagagactagttttcgtgacctaaaatacagtatcggtctgactcattttcatgcaaaaaagaaggaagggattctccaagaaatctacgctcactttatcaattttaatgtttgtaaatggctaacctcacacgttgctattaaaccatcaaagttaaaacaggcttataaaatttgtttttcagacgctgtttatgcctgtcgaaaatttcttagagaagaactcacttccttccaattagaaacctacattgctaagcatttatccattattctacccaatcgaaccttccaaagaaagataaaaagcaaggcacctgtaagctttacttatagaatatcataatagttaaaaaattgggttaaaaatcttcctttttgtgcgccctaaatacaaaaactattcccgttttgtcatcaattgctcagacgggaatagtttctttagctgcttaaatgcttaacttaatgacattgattctgactcttgttttctggtccataaaaagtacaaattgatggcacaggccactaaaatcacagcaggccaaagcaaatttaacaaaggaagtttaccgacattgtaggcaatatagagagtattccacactacccccaagctatagacaatcgtcaaaataattttcataagacactccaattaaatgatagtgctattatactacaaacgaccattgatgtccttaatctgccgttccattttccgatagtttaggaaaaatagcagagcgtataccaagacaaagatgagccagaaaaagagaagggccccaagtttcacgggaaaccagccagccaaaatgcccagcggtgtaaagcctaaaaccgtgaaaccaaaatgcgttgccgtcattcgtaaaaggctccaatcctgttcaaaaatcttgtctgccagctgaaacaagataccgattgtcgcccaaatggctacacaaatcaacatgacggttacttgactaaagttgctcaggtagtaagcacccatggttgaaaagggatttagaggaaggtaggttccctgtccgaagacggctgatgtgataatggagataatggttccgatggcgatgcctaaactggctgataagatgtattttttcatagtcctaacctttctttgataacttttagatagcgacgggaggagtaggtgaccgagccattcttcatgaccagtttgaccagaccgttagcagtcagtttgaggtggtccagttgcttgatgtgaatgatttccgactgagagatttgtaaaaagtttgccggcaagtcctccttaacctgatacaagcgtaggttggaagtataggtagtttctactgtttccacctgtaaaaccctatcttccaagtagagtctgacaatctcatcatgttccacaagatagacctgctccccttttttaacagttagactggatctctgcttatccaagttttgaatataggtcaccaagttagtaatttgctcagacatagcttgagcttcaatagtcaccaaatcttccaaaatctctgatgatatggctagttttactttcatattctctcctttctctttctgaccctattaaacaccatttctttactggtttcaagggcttttggctatgtggtcattttccagcactaaacggcaaaaaagccagaacaactgtcctgactttcattgtcttatatttttttcttcaactccgccaccgccatcatgacttccataggggtcatattgtagatgtctagtttttccagttcatcaagtactgggtgagaaggcgtgtctgcgaagagatcaagttgacctgacggttcttccactactgacggagctgggtgagttggtgcagtaggggcttggttttcaagcgtctgcaaaatccgatctgcccgctgcaatagttcctctggcattcccgcaatcttagccacatgaatcccgtaggacttgtcagctggaccttgggcaatcttgtggaggaaggtgacttggccgtccttctccaaggtcgatacatggacattctctaagtgttccaaggtctggctaaggtctgtcaactcatggtagtgggtggcaaagagagtcttggcaccaatcttgtcatggatgtactcgatgatagactgggccagggccataccgtcataggtggccgttccccgtcccaactcatcaaagaggatgagcgaccgatctgtcgccagacggaccgccttattggcctccatcatttcgaccatgaaggtcgattgaccactaaccaagtcgtctgccgccccaattcgggtgaaaatagcatcgaaaatcggtaattcagcctgatccgcaggcacataggaacccatctgcgccatgatgacgataaccgccaactgtcgcatataggtagacttaccactcatgtttggaccagtaatcagttgcatatgtgtatcggtattcaagtgaatagagttgggaatgtaggtctgcttgcccatgaccttctccaccaccgcatgacgaccacggtcaatggtcagttctctttgatctgtaaagcgtggacaaaccaaatgttgctgctccgccacaactgcaaaggcctgcaaaacatcgatggttgcaatggtccgagccagcttctgcaagcgacctatatacttctcaacctcttggcgaatccgcatgaaaatctcgtactccaaattagcagacttatcacgcgcctccaacatctgcccttcaatcttagccaactcttccgttccatagcgctccgagtttttcaaggtcgccttacggaaaaaatggtccggcacattgcccagattggaattggtaacatggaaatagtaaccgtcttttttattgtaatcaatcttaagattattgataccagatgcttcacgctccttggcctcaatctccgcaatccaacccgctccctcacgcatgactagacgatactgatccagcgtttcgtcaaagcctgtacggatgatgtttccatctgtgatggtcccttgggcttctgggtcaatagcagagctgatgagagcgtgcagttctgggattgggtccaatccagccaccaaattgcctagagcaggctcattgatttgttgcaagatattcttgattgctgggatatttcccaaagtctgggagagctgcaagagatccttgggcatggtttttccaaaagacacccggctggccaaacgttcgatgtcatagacaccttttaaagcctcgaccaagtcactccgttcaaagaagtaatccagaaaaacctgaacgacagcctgacgattctcaatccgcttaagatcaatcaagggacgatcaatccatgtccgcaatagtcgcatacccatggctgtcttagtttcgtctagcaaccagtacaaactaccatgcttcttgcctgtccgaccgttttcaagcaggtccagactggacttggttgcatagtccatttgcagatagtccttgatttcatagtggaccaccttttgcaagtggctcagatctcgcatctgagtccgatgtaggtagctgaggagtttacctgccgcagccttttccaagtctgtcaaggagttgtcaatcagctggacatcttccgtcacctcatcctcaaaagagagcaggaggttcatctggttcgaaaagacctgctcttcttcctcagataaagcatagccgatgaccaattcacgtgcccgtaaattgcggatctcaccgcaaagactagtaaaatcatccaaactagtcacaaaaaactgacctgttgacacatccatataagaaagcgcgaactgtactccctgacggtcaatcgcaaccaaatagttactgtctgctcccattttggacgagtctgttaccgtaccaggagtaatgacctgcactacttcccgcttgaccacgccgactgcctgcttaggatcttccatctgctcggcaattgcgaccttgtgccccaattcaacaagtgtgtcgatatactgttgtgccgcgtgatacggtacccccgccatgggaatcggattttccgcattcttattccgactggtcaaggacaattccaaaatctgtgccgcttctaccgcatcttcataaaataattcataaaagtctcccatacggaaaagcaaaaaagcatctggatactgtgcttttatatccagatactgctgcattcccggagaaattttttctgttgccatcatctctccttgttctaattcaaatagtagttaatctccgcttcaacttgctgagccgctacatcatctcgacaaataactaaaagtgtattagctcccgccagcgttcccaaaatagtctctggcttttctgcatcaatgatattggccatcaaggccgcttctcccagttctgaatgaaggaccagaataaaactagccctatctactttatacgcatattgtgccaataattggataaaattcacgcgctcttcttcgatagctaaggaataaaatgaacgcccgttttcatgaatttttatcactcccaactcacgtaaatcacgagacaaggttgtctgggttaccactacccctcgagcctctaaaccttgctgaatatccgtttgtcgccctattttttcttgacgaatcatggcctttattaaatcatgtcgtcctgctttattcatcattttacctcaaaatgtatatttatagaaatattataacacttttccccgctattagcctagaaatgtgttaaaatagaatcaataactttggaggaaatcctatatgaatcaaaaacaagtgattgcagaaagattggctgccatccttccgagtttggaagtggaagctatctacaatctgctagaaaaaccaaaatcatcagaaatgggcgatattgccttcccagccttctcacttgctaaagtggaacgcaaggctccacaggctatcgcagcggacatcgttgaaaaactcgatacaactggctttgagaacgttgttgcaactggtccttacgtcaacttcttcttggacaaggctgcgatttcccaccaagtcttgacagatgttattactgaaaaagaccaatacggtaaactcaacattggtcaaggacgcaatgtaaccatcgacatgtctagtccaaacattgctaaaccattctcagttggacatttacgctcaaccgttatcggcgatgcccttgccaacatccacgaaaaactaggctacaagccaatccgtatcaaccacttgggtgactggggcaaacaatttggcatgttgattgttgcctacaaactctggggtgacaaggctgcggtcgaagctgacccaatctcagaacttcttaaactctatgtccgtatcaatgctgaggcagaagaaaaacctgagttggacgacgaagcacgccaatggttcaaaaaattggaagacggcgacccagaagcgcatgaattgtggcaatggttccgtgatgagagcttggtcgaatttaaccgcatctacgacaaacttgatgtaacattcgacagctataacggcgaagccttctacaacgataagatggacgaaggtatccaaatcttagaagaaaaaggacttcttcaagagtctaaaggtgccaaaatcgttgaccttgaaagctacaatcttccaccagcccttatcatgaagacagatggcgctaccctctacatcacgcgcgatatggcaacagctatgtaccgcaagcgcacctatgacttcgtgaaaagcatctatgtcgttggtcaggagcaaatcaaccacttcaagcaactcaaagccgttttgaaggaaatggatttcgactggagcgacgatatgacccatatcaccttcggtctagtgaccaaggacaagaaaaagctctctactcgtaaaggaaacatcatcctgctcgagccaactctagacgaagctatttcacgcgcccttactcaaattgaagctaaaaaccctgaccttgaaaacaaggaagaagtggcacacgcagttggtgtcggcgctgtgaagttctacgacctcaaaaccgaccgtgacaacggctacgacttcgacttggaagctatggtttccttcgagggtgaaacaggtccttatgtacaatacgcatacgcccgcatccagtctatcctacgcaaggcaaactttgtaccaaacgcagaaaatgactacaaactggctgacacagaaagctgggaaatcatcaagcacatccaaaacttctcagctgttgtagaacgtgccggagacaaatttgacccatcacttattgccaaatacgctatcaacctagctcaagccttcaacaaatactacgcccacacgcgtatcttggatgaaagtccagagcgtgacagccgcttggcacttgcctacgcaacaggacttgtcctcaaagaagctctgcgtcttctcggcgtaaaagcaccagaaaaaatgtaatcaaagccttcggccatcagccgaggctttttttctaccacattgcctactctcgtttccgattccttatcacaacaactccttctcccaaatgaaaatcaaaaagattcatttcaattacgaatatatagatgggaggtacacgtgatacctctacatctactacacaaggagaaataatgaaaacattcttgagaagaaaaggaatcgcctgtcagcttctagccgccatttttattgtcggtatcaatttacaatccccaccttcagcctcagccaatgcaagaggagatgactatccctacacagcagttgatgcagtcgatccatggagactctacacacgccagtgcacctcctttgtagcctttcgacttagcacagttaacggttttacattgccacctgcctatggtgatgccaatgtttggggccatcgtgccaaacaagaaggttatcaagttaatatgacacctgctgtcggagccgttgcctggtgggaaactcccatgcatgtcgcatgggtttctgcagtaaatggagataccgtagagattgaggaatacaactacggtgttcgctatacctacggaaggcgagttatccccaaaaatgccgttagcggctacattcattttaaaaacctcggagcgggaacaaccaactctcaacccgccttagccccaagcggcacctatacctttaccagccaactggccatcaaatctcaagctagtctatctagccctaccctcgattactattatgctggcgaaagcgtccgctacgacaaggttcttgaagacgacggacaacgctggattagctatatcagctattctggagctcggcgctatatcgccatccagcctaccattactcaatctacaaacaacagcctaccagcatcaggtagctacaccatccagtcctactctagtgtccgcaacaatccaagtctgtccagtcctgaaatcaccttctacggagctggctcagtcgttcgctatgataaagttattactgccgaaggtcgcacatggattagctatatcagttactcaggtgctcgacgctacatcgccatctcctaatcacaaaaaatacaatatttaaaagcacaatcttttagactgtgctttttcattaaatatctgtcgaattaatagctgtgctcggtttttctttcggtttacgcagatggaagaagacggtcacaccaaagtaaatggcaaataggacaatgttaaggatgtaagcccctagcatacctgctgctgtcacatcacgcaaggctgcatctgagtagaggttggcaatccccttacctgctaggtagctataggtattcagcagtaaggtcgaaaatagatagccgatgtaaagataagaagccagctcatttttcttcatgaataagaagacaatgaccgcaatcaaaagaccaaacatgaccagggctgctgtcttttgaatgatacccgtctggagattggctgtttctctcgaaacaagaatcaattcttctacatcaatcccaacaactccctgcacagacgtacgaagtcgctcctcattaaaagtcgacacaaaggcactaaacagccttaaaatactggcaatactggatagtatcacaaaaatatacaaatgaatcggtcttttcataatagcctccttttttctatattttatactcatatttttatattgtcaatcatatatttcatttgactgcaaatataattttgttatactaagttcaaaggaggaaaactcatgaagaaattgcccacctatatcggagtgattatttttgtagtcactctactgattaactggttattgccaagtcttgctaaagtgctgaatacatttttcatttggactatcgtagcctgcctactctacaccatctactactggattcgctactggctctatgtccgacaacagagataacaaagactcctctaagttagctgcttagaggagttcattttattatgacttttcatcaaccaaatgcacattaacccgacgataagtttctgtaaggtctagcaattccgcttcaatctctggtgtcaattgatctgccgtcattctccaagtccagttaccaccaagcgtatttggcaagttcatgcgagctgaaccatccaaaccaagtaggtcctgcatagtagccaccgccataaaggcaggtgaaccaaagagcagacggaaaagagcatgactgaccgtttccccctcacgacgattgctgtacttatctaagaatgcacgcgattctttcgttgtttcattttcgtaccagccaagaatcgtatcattgtcatgggttcccgtatatgccaccacattattaggatggttatgtggcatttcaatgctgtctccttctggatcaaaagcaaactgcaggactttcataccaggaaaacctgtcgtatcacgtaattggatgaccttgtctgtcacagagcccaaatcctcagctatgatatttaagtctccgagttcacgtttgattgtatcaaataactcaaaacctggtgcttcgacacgatagccatttacagctgtttcttcacccgctggaatttcccagaaggaggcaaagccgataaagtggtcgatacgtaccatatcgtatatcttaaaggattcacgtaaacgagcaacccaccaagtaaatccgtcatgcttcatcgcttcccaatcataaatcggattgccccaaagctgaccaatttccgaaaaggcatctggtgggcatcctgcaaccacactcggcttgccttcttcatccgttttaaagaaatgtggattagcccacatatcggcagaatcagccgcgatataaatcggcatatccccaacaaactcaacacctttggcattggcataagcctttaaagccttccattgtgaaaagaataaatattgtgtaatgcggtgataatcaattcgatctgccaacaagtgacgataatattccaaggtatcgtggtaacgtaagcgcgccccttgatcttcccactctgtccaaggtttgagatcaaaatgctcttttatagccatatactccgcaaaggtatgaatccaaaagtcattctcccctaagaacatccaataatcttctggcaagccttgtgccttcatgttggcaactaccttctccagtaatggacgtcgagcataaaaaatggctgcgtaatctacctctgtaggattctgcccaaagtcaacaccgtgtaaatcctctgctgccagccagcctttatcaatcaatatatcaaaatcaataaaatgagtattccctgcaaaagctgaaaatgactggtaaggagaatctccataactggttgttcccaaaggtaagatttgccaatagcgttgcttagttcttaccaaaaaatcaacaaattcataagccgattggcccatggaaccaattccatatttcccaggtaatgatgaaatgtgcatcagcacaccactctgtcttactttcataagttctcctatctaatccgcttgcacaacgcaaacgttttctcttttttattatatactgaaaacggtaacaaatcaagaaatttccatttaattctgttagttcacatgccattccatatttcttttcattaatatatgcaaaaaaattcttatatttttttaaactcaaaaaaatttttaaaaatttttataaaaacgcttgcaaacggattcaatctagtgtataatgaagtcaacttaggaaaacgtttgcgcaaagcaagcgtcacacaaaactatttatcttcggagggaagaaaatgaaacacaatctccttaagagcgttgctcttcttgctgcatcaactgctgttttagctgcatgctcaaactcaggttcatcaacagaggcatctaagtctgctgaaggtagcaaagaattgactgtctacgttgaccaaggttatgaatcttacatcaacgatgtcaaagctggcttcgaaaaagaaaatggtgtatctgttaccgttaaaactggtgatgctttaactggtttggataacttatcgttggataaccaatctggttcagccccagacgttatgatggcaccatacgaccgtgtaggtagccttggttctgaaggtcaactatctgaattgactcttgcagatgatagcaaagcagatgacacaacaactgctcttgtaacaaacggtggtaaagtttacggttcacctgcggttatcgaaacacttgttctttactacaacaaagacttgttgactgaagctcctaagacatttgcagaacttgaaacacttgctaaagacagcaaatacgcatttgctggtgaagagggtaaaacttcagcattcctagctgactggacgaatttctactatacatacggacttctttctggttacggcggctatgtattcggtgaaaatggtacaaatccaaaagacatcggacttgctaatgaaggtgctatcaaagcaattgaatacgctaaaacttggtacgaaaaatggcctcaaggtcttcaagacggtactgctgcaaacaacttgattaacactcaatttacagacggtaaagcagctgctatcatcgaaggtccttggaaagcagcttcatataaagaagctggtgtaaactatggtgtagcaacaataccaactcttgtaaacggcaaaaactactcagcattcggtggtggtaaagcatgggttgttccagcaggcgctaaaaaccaagaaatggctcaaaagtttgttgacttcttgactgctacagaccaacaaaaagcactttacgacgctacaaacgaagttccagctaacactgaagctcgtgaatatgctgtaagcaaaaaagacgaattgacaactgcagttatcaaccagtttgcttcagctcaaccaatgccaaacatctcagaaatgggttcagtttggacaccagctggtaacatgctcttcgaagctgcaagtggttcaaaagacgctaagactgctgcaacagacgctgtgaaagctattgcagacgaaattgctcaaaaacacagcaactagtcaagtttaaagttggactgggagttctcttcccagtctactttattacttaacgataaactgaatagatatagtcttttagtttacttttagtacgaggcaatgagccgcaggcataactgaagttaggcaaggcgagttaacgaagtaataaaagaaaaactaaatgacgataacatccaccgtctattcagaagctatataaggagactatgactatgaaacaaaatccaggtaaggcactccttttgtccctgatccctggtctcggacaaatctacaataaacaaaaagccaaaggatacatctttttaggtgttacgcttgccttccttgtttattttattgctattgcagctggtgaattaggcaacttgattaccctcggtagtgttcgtggacaagataattcgctattcatgctgattcgtggttctttccacttaattatcacagttgtctatctcgctttctatgcactcaacctaaaagacgcacgtgataccgcgaaacgatggaattcaaggatgccagtggctaccacattaaaagaaatggtaaaaggtatctatgagaatggtttcccatatctcttgattatcccatcatatattgcgatgacctttgctatcatcttcccagttgtcgttacattgtttatcgcctttacaaactacgacttcaaacacctgccaccaagcgcattgttggattggattggtattaccaactttacaaatatctggaaactaagcacattccgtacagcatttggttctgtacttggctggacaattatctgggcactctgcgcttcaacagctcaaattgttatcggtatcttgacagccatcatcgcaaatcagccattcatcaaaggaaaacgcatcttcggtgttatcttcttgctcccatgggctgttcctgccttcgtaactatcttgacttttagtaacatgttcaacgatagtgttggtgctattaacacacaggtattgccattcctgagcaaattcctaccattcatcgataatttccttatcccttggaagaccgacccattctggactaaagttgccctcattatgatgcaggcttggcttggtttcccttatatctatgttttgaccctgggtattttgcaatccattccaaacgacttgtatgaagctgcttacattgatggtgcaagtgccattcaaaaattccgtaacatcacccttccgatgattttagcagtagcagctccaacactaatcagtcaatacaccttcaacttcaacaacttctctatcatctacctcttcaacaatggtggtcctggtagcgtcggtggtggagcgggttcaactgacatcttgatttcatggatttataaattaaccacaggtacatcacctcaatactcaatggcggcagcagttacattgattatctcaatgattgtcatcagtatttccatgattgccttcaaaaaactaaatgcttttgaaatggaggatgtataagatgaaagtatctgtaaaaactagacgcatactcaatcagaccttaacctatctctatctgattgttctgtctgttatcatcatctatcctctcttgattacaatcatgtccgccttcaagtctggtaacgtggttgccttcaaattggatagcaatatcaactttacactagacaattttagcaagctctttagcgagactctatacggaacctggtacttcaatacgcttatcattgctctcttgacaatggttattcaaacaagtatagtggtactagcgggttacgcttatagtcgctataacttcatcgctcgtaagcagagtttggtcttcttcttgattatccaaatggtaccaaccatggctgctcttaccgccttcttcgttatggccctcatgctcaatgcgctcaaccaaagctggttcctcatcttcctttatgtcggtggtggtatcccaatgaacgcttggctcatgaaaggctacttcgatacggtaccaatctcacttgatgaatctgcaaaactagacggtgccgggcacttcagacgtttctggcaaatcgtcctcccactcgttcgtccaatgattgctgtacaagcgctctgggccttcatgggaccttttggagattacatcctatccaaattcttgcttcgtgaaaaagaattctatactgtagctgtcggacttcaaaccttcatcagtgatgtgaagaatatgaagattgcctactttgcggcaggtgccattcttattgccctccctatcagtatcctattcttcttcctacaaaagaactttgtatctggtttaacaagcggtggcgacaagggataaccctgtcccaccttttccctttttaggggaaacattgatatttatgaaaggtccaacgaatgctcccatatcctttttcctatttttctagtatcttctctccaagaaatatgtttgccaatcgtagactaatgaacctttggcaacggttgtttacaacgctttttttagtggcgctcttgctcattccgagctccctacagactgtcaatctcgaaacctatcctttagaaaatttcgtagaaggtatctatgcacctctgacagatcaagtcgtagatgacctccgtcaacatgcagtcatcgaaaacaaccacctaacctatactggaaatactaactgggagcaagtgacatttggtgataccgttagctctagttctgactttacttatcaattcgccaatcagtctctgactattcgtaaaggaagtgatattctaagcgaattgacttatgaaggtttgaatactgacgattttgctagtaaggagaccttgactgcaaccatctctaaaaaatggtatcaagccaaccgagcagctgtcggactgtccatcactcttatttcgacctttattttaacaacaaacctactcttcatcctactaggagccagcttcttcctctttttgactaaaaagtctcgtttcttccattttgaaacgtttgcagagtgctataattttgctctcaactgtctgggcctgcctactcttatagcctgtctaattggactatttggtcaacctgtgactacccttctaaccatacaaaatatcctatttgtactatgcttgttatgggtatttttcaaaacaaaattcagagatgaaatctaggaggtctatatgcgtgctaccatcaaagatgtggcaaaattagctggtgtctcgccatctacagttactcgtgtcattcaaaatagctctgccattagccaaaaaacgaaagacttggttaggaaagccatggcggatctcaactaccatccaaacctcaacgctcgaagcctagtttctagctatacacaggttatcggactggttttgccagatgactcggatgttttctatcaaaaccccttcttccctactgccttacgaggaatttctcaagttgcggcagatcataattatgccatccaaatctccacaggaaagaatgaagaacaacgtctagaagcgatttctcagatggtctacggcaaacgagtggacggcctcatcttcctctattccaagcccgacgatccattggtacaattagctatccaacacaaattccccttcctcattcttggtaaggcggattctccattcatatcactagttgataatgataatatccaggccggctttgaagctaccaactacttcatcaataaaggttacaaaaacattgccttcgtcgctggtaacaaagagttagtcgtatctcaagaccgttatacaggttacaagaacgcccttaaatcgcacaatattcccctggatgaaaacaaggtcaagtttgtgtctggcttccttctcgaagacagtgcctacaaaatttctaagaaattactcaaacaagacctggatgcaatcgtcacaactgacacttccgttgccgaaggtgttgtcaaatatctcaacgaagtcggagtcaaacttcctatcatttcttttgactccgtcaagccaaaactagatattgaagcctacgttgacgtccacgctattaaactaggacgcgtcgcattcaacactctgcaccaaatcatcaatgacaacaaggaagacaagcaagtctgctaccgacgtgtcattccacataccattaccgaactctaacttagaaaggagccttttggctcatggcattacgacaatttcaagcatctcttgacgatgtagcaactattcgcttggtcatggaaaaacgattcgactccgaacatatgagcttctcacttgaatcaaatgatgctacatctcaactttttatccattcctgtctagaagtagataatctcgtcatctattatctaaccagcctccatgcactgacattggacaaggactataccatctacgaccaagaccgtaataaaacagaactcggctatggtcatatcgttcgctctacactttttgaacaaagttatacatacaatggccaagatttgggagcaacctatcgaccagaggcaacaacctttaagttatgggcacctatttctaagcaagtttttcttgttctagaaggaaacccacatgcaatgacgaagggagcaaaaggagtttgggaaattactgttgaaggagacctagaagcgcacagctatcactatctccacaaagtaaacggtgaatggatttccgttcacgatccctacgccctgtcttccacagccaactcaggtgacagctacgttatcaatccagataaacttcataaaattcgtcgtgctaagacccaacgacctatttctcaggccattatctatgaaatgagcgtccgtgatttctcatggcaaaaagaagctggtttcaagcatcgcagtcaatttctcggcttgacagagtctcctaccatggatggaatgaagctaggaatggattacatcagagaactaggcgttacccatattcaattattgcctgtttatgattttggcagtgtggatgaaaataaaccccaagctgtttacaactggggctacgaccctatgcaatacaatctgccagaaggttcctattctagccaaccaaacgatccttacgcacgtattctagagctacaagaagctatccaggcctaccatgatgcagatatttcagttattatggacgttgtttacaaccacgtctatcatgctgaaaagtacgcatttgagctcatcgttccaggctacttctatcgctatgatgaccacggcatgcgaacagacgggacattctgcggtaacgacgttgccagcgagcgcagtatggtccgcaactacatcaaacaatcccttcgccaatggctagaactctatggttttgatggcttccgtttcgaccttatgggtattttagatagcgaaacaatcaaccagattcaaactgaattatctgccattcacccaaatgtctacctctatggtgaaggatggaaaatggcaacaggcctcgaatttgaaaagctggctcaccagtacaatgcagagcatttacctgaaatcagcttcttcaatgacgattaccgtgatacctttaagaaactcttgctcaatccaaaccgtctaatagataagcaattgcacgaaaaggtacaacatctcctgactggtagccgattaagccatttcttaacgcctcaacagtccctcaactacatcgaatgccatgataatgctacagcatttgactatttccatattgagaatccaaactggacacctcaacagcagaaacgtgctgcaagttttggtctccagctcatcttaatctctcagggtatggccttcattcacagcggacaggaatttttccgtacaaaagatgaaatagataatacttacaatatccctgaccgtatcaaccgtctggactggacacgagctattcgttataaggaacatatcgagttcattcaggaattaattaccttccgcaaaaataatccaatactcagccaggataactacgaaagtatccaagaaacttgtgatttctactggttaactgaatatgttcttcgctatcaagtgacaagtgaagaaaagaccattcaatttatcatcaactttgcagatagcgactttacctatgaacgtgaaaaagataaggcagttctctacaactatcctccagtcgaagagcgtgatcagcaagaaatcacgattgcaggacagagtatttgcattttagaagacaaataggactttagaccgatgaaacacgatatagtctgaggtatactatagtcaatcctaaatatttttcataatctccttaaaactcactagtcactctggtgagttttttttgtgtgaccaaaaaaacaacccagcataaagctgagttgaggctctttacatcaattccattatcttccgaccaatgcgttcaatgtcattctgcatccctctgagttcaaaggtgtctataacaggaaaattaaatcgctcagcatattgcttggcagtcagacaatattggttgttaaaattgcggttacctgagccaacgacacccagacagagctctgcattggtccccaaagcgataaaatctccaagaggattggtcagaatttccacatctccgttgtccactccatttccaccttctaagtaggttggtaaaaaggcgacaaagggtgcatctagctgatagaaaggaatagcctgcttgaccaaatctttgacatgaactagctcaatctcccagtcagtttgaaattggaaaaaggactttagacgtttcacaaaactctctgtattgccactcaaactgatgtaaaccaaatatattttcttcttcatacacttcctctttataataaaaacactacatgtagactgtaaatactattttactcctacatgtagtgtttgtcaatcagtcgctttccacaaaccgaccaataatattgacgttgtcagctaccgatacaaaggctttggggtctgcctttttcataatatgcttgaaatcattaaactccgcacgagtgatgatggtaatgagaatcgtcttttgctcatggttataagcaccctcagcaccgttgataatggtcacaccgcgattgagcttcttatggattttcttaatgacacgttcaggatgattggtaataatcatggcctgcatccgtttttgtttcacgaaaatcgcatctgtcatgcgactggagataaacagcgcaaccattgaatacagggcatattgccagccaaaggtcatccctgcaatcaacataatcataatgttgacaatcaaggaaatagagccgacttgtcgtcccgtcttcttgcgaataataatagagacaatatcagtaccaccactggatacattgttcctaagtgcaaagccaatcccagttcccagcatgagaccaccgaaaatagcattgactaacggatccgtcgtcagggtaactggcggcataaattggataaagaaagaactgaaggataccgtaataaaggtaaagatagtaaatttataaccaattttataccaagctaagataagcaagggaatgttcaggccgtagtagaccaccgcaatcggtacattccaaccagcgtaagaagctgccagagcagaaacaatctgtgcaagaccagtaactccagacgaatagacattccctggtcgaaagaaaaaattgactgcaatactagataggagtccataaataatggaccccgatatccgttcagcatatttttcccgagaaattcccaaaatgaccgaccaaaacttattctttctggcctttcttaaaaagcgtacacgctgttttctgaaaaatttattcattttcaagtgtaatgtctaaagccaattcctctaattgagctgatgcaaccgtacttggtgcctgtgtcatcggatcagatgccttgttattcttcggaaaggcgataacttcacgaatgttatcctcaccagccaataacatgacaaagcggtccaacccgatagccaatccaccgtgtggtgggaaaccgtagtccatagcttctagcaagaaaccaaactgctcatgggcatcttcagctgagaaaccaagagccttgaacatctgttcttgcatgtctttttggttgatacgaaggctaccgccacccaattcataaccattcaaaacaatatcgtaggcaactgcacgcacctgcgccaaatcaccatccaaatgatgagctgtttcttccgtcggcaaggtgaatgggtgatgggcactcatatagcgaccttcctcttcagaccactcaaacattggccaatccacaatccagaggaagttgaacttgctttcatcaatcaagccttgctcttttgccaagcggttacgcaaggctcccagggtattgttggctacttccaattcatctgctacaaagagaaccaaatccttgtcttccaactgtaaacttgctgtcaatttttctgtaatacccgtcaagaacttagcaactgggcccgctaattctcccttgtctactttaacccaagcaagtcccttagcaccaaattgttttgcgtagtctgttaatttatcaatgtctttacgtgagtagctatccgccgcacccttgaccacaatggctttgacaactggtgcttctgagaagaccttgaagtcaacttccttgacaagttctgtcaagtcttgcaaaagcatctcaaaacgagtatctggtttatctgaaccgtagaagttcatcgcatggtcataggccatacgtgggaatggcaaggtcacatcaattcctttggtatctttcaagaccttagcaatcaagccttctacgatgtcttggatttcaacctcattcaagaatgaggtttccaagtcaacctgtgtaaactcaggttgacgatccccacgcaaatcttcatcacggaaacacttaacgatttggtagtaacggtcaaaaccagcgttcattaaaagctgcttagtaatctgtggactttgtggcaaagcatagaaatgacctttggacacacgagatggtaccaagtagtcgcgcgcaccttctggtgttgacttggtcaacattggtgtttccacatcgataaattccaaatcgtccaagtagttgcgaatgctgtgggttacagccgcacgtaatttgaagttgttgagcatttctggacggcgaagatccaaataacggtaacgaagacgggtatcatcactggcttcaatgccgtccttgatttcaaacggagttgtcttagccgtgttcaacactgtcaagctggttacttgcagttcaacagctcctgtcgggatattgtcgttagcttgctcacgctccacaaccgttcctgttacttcgataacaaactcggaacgaagactctccgcttttgccatcacttcagcttcaactgactcagggttaatcaccaattgcataatgccttcacggtcacgcaagtcaatgaaaatcaggccacccaagccacgacggcggccaacccaacctttcaaagtaatttcctgtccgacatgttctttacgaacacgtccagcgtacatagaacgtttcattttcttcctcttttactgattttatacctattcattctaccataaaatagctgattttggggagaaattgccgagaaaaatcgaaaaaccagccctagttgactggtttactatataacatatctaaatgcggaatatcatcctccaaatatacttcagaaactggcttaaagccaagcgattgatagaatttttccaaataggcttgggcaccgattttaatctgactttccttccactcggttgtaatgtaatggatagcttgctccatcattggcctacctaaacctttgccacgatgacttggcttgatgaccacacgtccgatggaaacttcatcataacttagaccagctggcaagattctcaaataagccactaactccccattgtctgttcctaaaagatgaagacaacttggatcttttccatctatttctggatagggacaggcttgttccacgacaaacacatcggtccgaagtgtcaagatagtgtaaagttcatgtaaactaagttgttcaaatgtttttatttcccacttcatacattcctcctagggcagaatgttccctgcacttctgtaaatctcataccattctggtctcgttaaggtaatctggctagcctgggcaatctttgtcaggcgacctggattcatagaacctacaatcgtttgaatctttgctggatgacgcaaaatccaagctacgacaattgtttcatgtgaaacattgtatcgctctgctatttcctcaatagtttgatttaaatgagcatagtcaggatagttggcaaaaatacctcgttgcaaatcaatcaagaaaggagaccaggcttggatagtgatttttttaagctggcaatagtcaattaacccaccatcacgcatagtcgcagcatcatctttcatattgacatgtaatccagcatcaatcaaaggcgtgtgagcaggagatagctgcaattgattaactgcaagcggttgatcgagataggattgtaataactccatttggtaaatgttttggttgctgacgccaaaatgatgaaccttccctgcttttttcaagagataaaaggcttcagctacttcctctgcttccattagagcatccggacgatgtaagacgagaacatctaaatattccgtatccaagcgcttcaaaattccatctacagattccaaaatatactcttttgagaaatcaaaatagcctttacgaataccacattttgattggaggagcatgtcctcacgtttcaatcccgccaattttgccccctgagcaaaacggatttctgattcaccaccaccataaatatccgcatgatcaaaaaagttgattctttgctcaaccacggtttccaataccttggctgtttccttctctctcaaacttgccattcgcatacagcctaaagcaattcgtgaaacttctagacctgtttgtcctaatctttgcatttatcttctcctttgtaaacgcttttcatattccttattataacagaaaaactcagccgaaactgagttttagttaaaaccataaattcttttcgcgattttatagacggcattggaaatttttcgacctgggtaaccgtaaaggttggttaattgcccgagtaacccttttcgaacgattttaaatagagctggattattatcccgaatatagtgccagagttcctgctttttcatcatatgttcagctgttccagcacgattgagaagagcacaggagataatggtcgtaatctccacatgattgagcaaataacttcgtaaatcaggattgtcaatcgcctccaagtctaaattatctaccaaaattcgattgacttttaactgctggtcaatgcgcttaatcatgacggattcattgacagactggtcatttcgcccaataaagtaacgataaaaatctactggcagatagaacatagttttcacagcctgcaaaggagtaaatacgaaaatattatccacatagaaggtatgctctggcagaacgagaccaacctcacgcaataaatctgtcctgtaaatcaaggaatgcatcatcatgtattgccccttggaaaaggcatccacatcttcccagccaaaaatccgattttctggtaaaacatcctgataagacatggattttttacgagattgtccctctttttcgtaaacaaagttggagataaaggcatcaactggcgtattttcatcttccaaagcctgcaaactctctaggatcttcaaataggccctggtatcgacccagtcatctgaatctacaactttaaagtacttccccttggcctcacgtatccctgtattaacagctccgccatggcccttattgtcctgataaatggcacgtacgtttgaaaattgattctctagcccctctgcgatttcctgagtccgatcggtcgacccgtcgttaataatcagaatttcaaccttgtcaccgcccattacaagggaatgaacacagtaatgaaggtaggcttccgaattatagctcggtatggcaatgcttagtaaggtcatctttctctccatttgacacaatttgttactattttatcacattttcaggaaagttgcttttgatattttctttttgcttgataggctctccatagttggcctaagcccttgaaaaaatttccattgacaatggttagaatcccttccaccatcggtaaatcgagcatgtctcctgtcatctttgccattgccctaaatggcatattataaaggaacagcaggttcaagtcaggagtccctttctgctctgcttttttcagtaagccagccaacagtttatgcacgccacgtgccaacccactcttcgcaaattggagtttcaaaactggatcgttcaggctcagttcttgaccaattttccaggtttcttctggaactggacgtccaagcaattgtgcaaaatcctgctctgaaacagcctgcacttgggctgtcagataagtcggaatctgttctgaagcaggaaattggtctacagtgccttctcgggtaatctcgccaactaagcgaatatcctgactacttgcacctacatacaagagataatttccagcctctacttcaaattggcctgtctctttattaaaataacgaaacgtatagtcctcaaaaggaataaaaatctgtttggactcgcctgcttttacatatacttttttaaagccttttaactcctttgcagggcggtaaatctgacgaacttctttgcctacgtacaattggacaatttcagcaccatcaaccagaccagtatttgtaatagtgactctgactcctaattcggtcacatccaattgactgtaagaaaagtctgtgtaggacaatccataaccaaagggatacttgacagtcttgtcaaggcttgtaaagtaacggtagcctacatagagagcttccttatagagggaaaaatcgccttccgctggatagtcatccgaagatggaacatctgcaagattaataggataggtttcgcttagttttcctgatgggttgacacgtcctgtcaaggtatctaaaatggctctggcaccagcttctcctgatagatagccgtgaagaaccgcatctacatccacatcccaattcatatccacaactgagcctgctgataggacaacaacgatttttttacctgtccctaccaaggcattcagtaaggataactggtttttagggagacttatatgatgacgatccaagccctcactttcactcatttcatctagccccatatagtaaagaacaagttccgcttggtttgcaagattgacagccctgtcaactaacaccctgttttctttatctacacgttgatagccttgttcgtaatcaatgacatttaatggataatctgcgatgcaatccactgttttatctaattgtcttgtattgattaaagaagaacctgctccctgatagcgaggattttgggcaaattctccgatgagagctatttttgtctcactagataagggcaagatctgatccttattttttaatagcacaatgctctcagtggcagcctgacgggccaattcatgttgttcagaataatctacagattgtttttcagcatgagccaactctaaaactacatcaatcagctcatccacgcgctcattcaatacttgctcggatagacgaccagactgaacagcgtgaatgatttccttttgaccaacctttttagtacctggcatttccaaatgactaccattttcaacaccgagaacatggtcattggagccaccccaatccgatacgacaaagcctgtaaagccccattcatcacggagaatgtcacgtaagaggtgcttgtcttcattagcgtagacgccgtttattttgttataggcagacatgattgcctttggatttccttcacgcactgcaatctcaaatcctgtcagatatagctctctcagtgtacgctcatctacaatggagtctgaagccatacggcgcaattcctgactgtttacagctaaatgctttggcgttgccgcaacaccttgcgactgcattcctcggatcattgcggccgccagttttcccgcttgatatggatcctctgaataatactcaaagtttcgaccacataagggactgcgcttgatattaagccccggccccaaaatgacattgacacccaagctatttgcttctgcgccaagaccctgtccgacacgttcaaccaggtccacatcccaagaatttgccaaggtagcagctgttgggaaacaagttgcagggacagaggcattcagccctaagtgatcaccttcaccttcttgcttgcgaattccatgtggtccatcagacaaaaagatagatggaattcctttttcagggtaatcctttgtttcccaaacagattttcctgacatgagagctgctttttcttccaatgttaaacgattaataatctcctgatacttcatcatcttttcctcattctatttctttatcactatcatatcagactaaagggacaattaaaacgctttcttcataatctgtatgattttggacataatctgctataaaaaatctccccagaaaatactagggagatcgctcctattacttcttatactcaatgaaaatcaaaatcaggctagctccaacagtctgagaatagactgttggaggtgggagataggacgaacctagttcgtttctatatgagcagatagaactctgtcgctttattattgtcaagcgacaggctggaaacctccactggaactttccactcatcaaatcaagccaacaacggctgagtttgattttcgaagagtattatttcatgattacaaacttcatcattggatagttgacagccacttgaacgaaaatattgacccagttggctgctgtctgtgcccagcccaagctcaagccccatgatgtaaagagttgagtggtgtaaggcggcagcacaatggacaaaattcctgcaacgacaacagtcaagatataccaatggagggttttggatatatcgttttctgctccgaataccaacttcctttgaacaatatagttgacaacctgtgccgctatgtaagccaagaggaaggagagaaagccgttcaatccgccattttctacggaataatgaaagataaaccagtgaaatggctgacttgacaaggctgtaaagaggaaattggttgacaaccaaaggacgcagaagtttgtaatagttgcgatgtttgataagacattaaacttgataaactcccacaaatctgggtgtttggcaatccattctttcatacggtctcctatgcaagacaagggggaaatcccccttgttatgctacttctttttcttcttttttcttacctgtcaacttaacgagtccaagacctgtcaagccgataagggcaatattacttgctaccaatacaacaatccaccattttgtttttggtttatagatgtcaaaggctgcagaatgagcaacggtgtacaagatgttcttacttgcctgacgaagtgctgcaacaccttctttagtacctgttgaggttgctgtcggtgcatcacctactggggttaacataaggtcgccaccattgcggattgcttgatctggactcatgtagtcttgaccgtcaaagtccgtaataaccattcctctgaagccccactcgtcacggagaactgtattcaagaggtcgctattaccccctgcccagagggtaccaatacggttaaaggatgacataatagcagtcgctccgccttctttgacaggaatttcaaaggctttcagatagatttcacgcattgcctgttcatttgaccatgttgcaacaccttctcggttatcttcttggtcattgagagcaaagtgtttggtaaaagtatagacaccattttcaagagcttttgctaccagtgagcttgccattttacctgaaatcagtgggtcttctgaatagtactcgaagttccggcctgagaatggtgagcggtggatgttcactgcaggagcatatagaccaacaataccgtgtgccaatgcctctttagcaaaagcatcacccatttcttccgccaagtcggtattccaagtagaagcaacaacgacttctgagttgtattggatacctttgataccttggaagataccgttgataccagcaggtccgtccaagtcaacaacagctggtttatcgattgatttgactgctcctgttgcataaccaccaaagccaaccaagttgaccatttcatcaacagacatttgagcaactagttgttcccaacgctcatcatcatagtttgcaccaatcaaatcaaccaaacgaagtccattgtcttctgttgtcacagtatcaatcggtgtttcagatgattcgtcaatgcggaagtttgcgttgttaatttctgtagcaatttgctcacttgcttctttgtcttttgtgcgttcggttggcaaagtaccgtcccaatccgcacgggttacatagttgatatcgcccacagcatattcaaaggcgttggttacttcagccttatcagatgaacgttgtttcaagacttctttgctatcaactgtgtaggtttctgaatccaagacatcatgcgcattgttcatgagtttgatttcatagtcacccttgtccaaaacataggctttttctgtcttttcgtcgtaagatgccatatcatcacggtcgaaggaaatggttaattcttcgctcttacctggctcaaggacctcagtcttatcaaatccagccaagacaacgtgtgatttctcaacaccaccttcagtatatggagctgtgtaatagacttgtgcaacttccttaccagccacgtcaccagtattggttactttaacattgacctcaatcttgtcaccattttctttcatgctagtgatttcttggtcaaagttggtatagctcaaaccgtaaccaaatgggtattgaacaactttatcataagctgcttcgtccacttgaccagtcgcattgtcaacaaagcgagtttcgtagtaacgatagcctagatagataccttcttgatagttaacaaatttgtagttaaaggtttgtggttcttttgctccccatggagttttttcataggtgatattagtataagagaagtcacctgtattccagtaggttggattgctttccaagtcgtaggcataggtatcgaccaagcgaccagatgggttgacctcccctgccaagatattagctacaccagtcaagccggttgagccaggaccaccaatccaaagagcagcatcgacgcctgcatcttctaagaagccgagttccatggcatttgaggagttaaccaagacaacaaccttgtcaaagttctctgtcacagtcttcaacatggctttttcaacttcttgaagttcaaggtagtgcttgtccttgtcaccttgttggtattctgccatgttttgtggaaggtccgcaccttcaccaccattacgagaaatgactaccaaggctgtatctgaaaagttcttcgcgtttgttaacagttcctctgagtatttgtcttgagttggctcgtagatattgtaatctccaccattgagggagaaaatatttgtcccttctttttctggaaggttttctgtgtagaagtctgtcaattcgctgttgacttcaaaacctgcattttcaagaccttgttgcagattgatgtttttggactcatctgccgcacctgaaccagatccaccgtaagtaatggctacagaagaaataccaaagacattgaccttggatgatttttcaagtggtagggtcttattcttgttttcaagcaagacagtgccttcttcttgaatggtcgttaccaaggacttagaaacttcttctgcatcagcaattttagcagcatctgcataagacggcgcaaaataggtgtcgatcacattgacaaacatattgacagcatagttagctccaacgataatgatactcaagagagccaagaggccaaagcccaactttttcttcttgctagagagggatttttccttcactacgcgataaatcgcaaatcccaataagccaaggacaactacagcagaacagataaatactgtttttgcaatcccgaccgcatccaatgattgatagctacttggatagctatctgcatagactatttttcctgatagcagagctcctgctaggctcaagagagcccctttccttttccaagtcttcataagacttcctcctaaacatttcggctttcatgtaagccttttctttttcttgaatccactatatcaattaacatactcaatgaaaaccctttcttcataatctgtcatttaaccttcataatttgtaaatttataagaataatcctactcttgctattttatcatttgattttctaaaatatagctaacaatttcattttaattttgatatactgatagaaaataaaaggggtgctttatgaaaatcgcgattgtagaagatcaaaaaattgagcaagatagattgtccaactacatcaaaacctactgcaaaaaagctgggattgcagtggaaatcagctgttttaacgacggtctccatatcactagtgactatcaaaaacaatttgacctgatttacctagatgtcgagatggagattatggacgggatgaccaccgctcaaaaaattcgaaatcttgataaggaagttctattagtatttgtgaccaatcattcccatgtcgctattcagggctactctgttgaggccattgattttcttctcaaaccactgagctcctttgtctttgaggaacattttaaaaaaattcttagaaaattacccgatagccaagagaagcaaagtttgtatataaaaagcaagcagtccaccgtaaaactctatcaagaagatattgtttacctagaaagtcaaggacatcaggttcacatctacacagttgacagtggcctaaccattacccataatagtctcaaaaatctcgaagccatgttaaacagtaaattgtttgtacgagcccactcggcctatatcatcaatttgtcccatgttcaaaaagtggaaggtagccttgtttacgtcacaaatacagccttgccgattagccgcccaaggaaaaaagaatttatgacagctctaaccaacttcatcggagatagcctactatgatcaatttccctgatattccacgtttctatactgcactaacagaaagcttggcctgcctactggtatgttcctcacttgttttgtctgaaaaatggtcacgcaaacaggtacgtatcctcctgatttttctcatacaaatcttacttcaactagcggctggcaaactccccttgctcctttggactgtaggaatgggcaccaatatcgcttggatgtttgtttccgttcgatttcttggagttatccacaagaggactagtctctatttgacagcaaaagcctttattattgccgaattagtagcctccattacttggcatctctactgtttgacgatttatcaacaacctgtggataacttgtggacacaggggttatttctgttgataacttctctactttcctattggctcatctatcttcaagatcaaaaagttcgcttagaagaattggataaattcattgagcagcgagatgtgacggtagccgtctttacaactttatctatctttgttctcagtaatattggtttcatcctctcaggcacgcgccaatttcaagattcgaccagcatcttcattctccggacaaccgtcaatctctctggtcttctactcctattcacccaagaatctcaacaatacgatcgctatttacggcaggaattgacttctatcaataatatctttcaacttcaatacaagcaataccaagcctatcgtgaaaacagtgagattcttgaccgtaaggtccatgatttaaagcatcaactggccatcattcagcaagaatcggataaaaccaaaaaggagcaatacctagaggaaatgagcgaggtgatccagacacttgatgccaagattgaaacaggaaatcccgttctagataccattctcagccagaaaaattattactgtttgcaaaatggaatcaactttacctgtattgttcagggagaacccctccattttatggatgtaatggatatttcagctctgtttggaaatgccattgacaatgccatcgaggctgtggaaaaaatagacaatcctgaacaacgcttgattactttaaaggttgccagccatcagcaatttctcatcatccgattagacaactacgatacttcttcgcttgacttatccacaggacagctcccagaaacatcaaaaacaaataaggactaccacggattcggtcttaagagtatggagtatgttgccaataaatacggtggcagtctcacacttagcaaggaagataattgggttcaactaaagatcattctccctttacaagtatagaaaaatcccgcttgaaggcgggattttctttctattcatcatttagaaaccgttacttgctccacatctcgactttgactccgttttataatcacatcaagataatcagccaagaaacttctcggtgatgctgcttgcaaggtctgataagcctggcttggaaataccttctcatctagccaagtctgatctagtttttctcctgaaaaataagcacggttggccggcatgataaattgtgaaatagcgtctgccgtctcgccgtcataccaacgctcatcgttcaacacattgtggaccatgatgtcactggtattgtcaaagacagtttgtaagtaggtaacgtgatcctgcaaatttggatcactaggttggtgcttttctgcccacgaagccatatcaagttgagttttttgatagtgaatgcttgtatcatcaaggctcaattgaccgataatagctggataaatagaaaatgctccattgaccacttcagtatagttaacttgtcccaagtcttccttaacaatattctgagaatgagtatggcctgaaaaaccaaaatgaatcccatactgatcaaacaaagccttcaaatcggcagcattatccaaagtatagccttttgagagcatggcatgctgttgcaagacattgtgatggacaacaggtaacaggctcactccagcttccttggctgcctgaagctgaacttctatccattctagggtctcttttttgatacatccattggttggaggagctccttttccgtagccgtcagagtagatgttgctgtctatcatcagaaaccaagcattggaaaatggtttggccaggtagctcaatgaggctttgtcacgactgctagcttgttgataaccgtgattgacaaatagctctgcaaattgctgagcagtgacctgatccgtcactatctgctggtctcccttaaaggctctagcccatccactggcaatatcatggttgccaggaatcaccaaaacctccgttcctttttcttcaatccgggtaaaatattgcgccaactcaaccatgctctgtttttcaccgtttagagtcaaatccccactgactagtaataaggacggttgctcacgctcaacctgctcaaccaaagcctccatccgctcttttccataacgtaaatccttaccagcagctgttttttctatataggaaaaagcctctccatcatcaaataaatcctgtgacaaataatgcaaatcagtgataatccagattttatcctggtctcttaactcagcctcggcataggattgctgacgctggccagtaatagccgaccaagtcaaaactataactgcaatagctcctaataataatactattttcttcttcataccttaaaagtatatcatcttagagatagagggacaagaaaaagaagctcgaccttctttctgccgagcctcttatgtctacaatttatttcttagcaaatccagctgcttgttcaccagcctgacgaccaaatacgatgatgtctgctgctgcattaccaccaatacggttttgaccatgaacaccaccagttacttcaccagcagcataaagaccagaaattgctgaaccgtctgttttcaatacttcagtattggtattgattttcacaccacccattgtatggtgaacaccaggtgcaactttaatggcatggtaagaaccagtattcaaagcatggtccatacctgatgtacgaccaaatgccgcatcatttttgtctgccacagccttgttccaagtatcaagtgttgtttgaagagcatccgcaggtacaccaatttctttagccaaatctgcaagagtagcacccgtttttacaagacctttttcttcatattgagcaatagccttcacacgatctttcaaggcatcatcaaagataacataagcatagtttggatccaaactattgatagccgcagaaactttatcacgagtttccaattcgttaacaaaacgctcaccttttgagttgacaaggatagcaccttcgccacgaactgcttctgtaatcaagtaagaagtttcttgctcaacacttgggtgaatttggatttgttccatatcaacagttgctgcaccttctgattcagcaagcgcaataccgtcacctgttgatccttcttggttagttgtaacataacctttcaatgctgggtttaatttagcaaccatttccaaatcagcaccgaaaccaccagtcgccaatacaactgctttagctgagattttcttagtttcaccagcaatcttcacttcaacacctgtcacagctccatccttgtcttggagttttgtaacatctgcattgacaaaaattggtacttcacgttcaacaagattgtggtaaagaccatttaccaagtagccaccgacagctgaaccatctgctggacggtgggtacgtttctcgctcataccaccagttgtagttaggttgctaagagtgatccccattccatccaaccagtcaattgcactagcagagttatctacaagataacgaagcaattcaggatcgtttgtccctttaccacctttaagcgtttcttcgtagaatttatcatttgtatcagcaataccttccgcttcttggaatttagtctgtgaagcattcataccagctgatgatttagccgtattaccaccgataacaggcattttctccaagagagcaacactagcaccagcgtctttagctgagatagctgctgacatacctgcaccacctgaaccaacaacgataacatcgtagctatctttcaactcagatggatctgtataaactttctcagatgcacctgaaacagcttcttctgatgaagaagaagtcgtagatgatgaagatgtagctgtcttttcagacttacctccacacgccactaaaaacaaaacagcaagtagactcattaataagcctaaccaagctttctttttcatataaacctccaatttttatctggtattagtattatacaagattgtgaaatgtttttcaatttgttttgaaatattttcacaaacatgaacaaaaaaatgtatgatatccgcttcatacattcttaaaactatttactgcccttgaagagctaaaaaattctctatttcggatagcgttgcttggctccctttacggagtattccagataatttacctgatttatagtaggttaagctaggaaccgtagcaagaccttgactctgtcgaaattgttgtatttttccattcggatccgactcgctatctaaatagtagatcgtcgcatgtgattgctctactgcctctgttaatttcggaacaaaatcacgacaataagggcatgtctcacgacctatgtataatataaattcttcctcgtcttggaccttttgctccacttcgtctatcgaaatagcctggtaactctttacagccttcacatagtctgattcatttggcgtagccgctgattgagatagaaagaaggccccacctacgaccaaaatagctaatagcactagcaaaaaatacttacgccacataatccctcctcaaatacagacaaaaagcccttgtaaatagggcttttaaaatatcgatacaaatcttagagcattttgttgtagaattctacgacaagagcttcgttgatttctgggttgatttcgtcgcgttctggcaagcgagtcaatgaaccttcaagcttttcagcatcgaatgatacgaaagctggacgtccaagagttgcttcaacagcttcaaggatagctggaactttgattgacttctcacgaactgagatcacttgaccaacttcaacacggtatgaagggatgtcaacgcgtttgccgtcaacaaggatatgaccgtggtttacgaattgacgtgcttgacgacgagtagttgccaaaccaagacggtaaacaacgttgtccaaacgacgctccaaaagaagcatgaagttgaaaccaagagtaccttgtttgattttagtagcttgtacgaacaagttacggaattgtttttcacccaaaccgtaagagaaacgcaatttttgtttctcagccaattgcaaaccgtattctgacaatttagaacggttgtttggtccgtgttgacctggtacgtagttacgacgtgccaattctttacctgtacctgtcaatgacaagccaagacgacgagcttgtttccaagatggtcctgtataacgtgacataagttatgtcctcctaaaataaaaatttccgtcatttcgtttctcttttattacgtcgttaagtcggcttggcatacctcagtatagcctgcacctccttgcctagtactaaaaggaaacaaaaagacttatctgtaggaaataacgttttaagcaaacctgattcgtgcaggaggccttcatcgaaacagcaacgattactcttcttgctgaccttctgttgacgagcttcattttgccctgctgttatttcacacaaagattagtatagcacaaaaaaaaggctctgtaaagccttatatagcgattaatccaaataatgaatcaaaatcttttcagtcaaaatgtctgagtaagtataagattccacaaaggtattgtttggatcttcaaattcaacgatgaagagagactgataaacctctacaatacgcccctgcttattcttctcacgcttacgaccattttcaagggtcaactcgacaatctgtccctcatggtccttaatatcttgtttgatttgcttcatcttagcaacatctgtaaatgcatcactcattctctatccatcctccctcttggaaatacttgcaaatttattgtattctttttggaacatgagttccacggtaccacgcgcaccggaacggtttttctcgatgataacttcaaccgtattattgggaataccaccgtcttcttgctctcctcgttcataataatcatcacgatacaagaaggcaacgatatccgcatcctgctcaatagaccctgactcacggatatcagacaagacaggacgtttatcttgacgttgctccacaccacgagacaactggcttagagcaataactggaacttttaattccttggctagaattttcaattgtcgagaaatctctgaaacttcttgttgacggttttctcgaccggttcctgtaatcaattggagatagtcaatcaaaatcaaacctaaattccctgtctcctgcgccaatttacgagaacgcgagcgaatttcggtaatcttgatacctggagtatcatcaatatagatacttgctcgagccaaattagcttgagccaccatatacttgttccattcctcttgcgttaggtgacccgtacggatagccctcgaattgataactccctcagaagcgagcatacggtcaaccaagctttctgcacccatctccaaagagaagatagcaactgtcaaacccagttttgtaccgatattttgagcaatattgagggcaaaagccgtcttaccaaccgcaggacgagccgcaagaataatcaactcttcctcatgcagacccgttgtcatggcatcaagagcaggatagccagttgcaatccctgtaatatccgacgtctgcttagcacgagtttcaaggttgtcaaagttgatattcaagacatcatcaatccgcttgaaaccacttcgactggctccctcactgacatcaatcaaagctttttcagcattggcaataatgtcatctgaaccatccgtaccctcataagcctgattaactgcatccgtcaaacgggcaatcagtttacggagattagacttttcagcaacaatcttggcatagaattccgcattggctgccgtcggtacggaactaatgatttcagccaaataggccaaaccaccgatattttccaaatcaccatggttcactaaatagttacgcatggtagtcgcatcaattgcctcatttctatcagaaagagcaatcatagctttaaaaattagcttatgagcatgtttgaaaaaatcttcagcttcgatgtattcacgaacgaagaccagcttgccttcatcaaggaaaatagctcctaataccgattgttcagctagaatatcctgcggttgcacccgcaattcatccaactctgccaagatctcacctcctcactggctagataaataattaagcttccttaatactcaaattaatgatgcctgttacatcttgatagattttaactggtacatcaatgagaccaatcgcacgaattgggtgatccagctgaatatggcgtttatcaatcttgatgccaaattgcttgtccaattcttcagcaattttcttgctggtaatagaaccaaaggtacgaccatctggaccaactttttcgacaaatttcactaaagtagcttcctcagccaacttagccttgatagcctctgcttctgcaatcatctctgcatgagccttttccttagatttttcctgaccacgaagggcgctgattgcttggtttgttgcttccttagccaaatttttcttgatcaagaaattttgggcgtaacctgttggaacttccttaatctcaccctttttaccttgacctttaacatctgctaaaaagattactttcatatctgttctcctaatttccatttatttcttcgcggattttatccgtcaacttttcacatacttctgcgattgtctggtcatatacctgagcggcagctaggttaaagtggccacctccacccatttcttccatgatgcgttgaacattgattttattatgactccttgcagaaatagatacataccctttgatatttcttgttacaacgaataccgcctcaattcctgccatgtccaatattgtattggcagccttactcggaataatattatcgtattctttagtatcatctgcacacgcaataacaacattggactcaattctctgcccacttaaaatcagttcattgatttgacgatattcctcaaaatctgtcgcagcaatctgctggatttccaagctatcgctaccacgagtccgcaagtaactagccacatcaaaagtacgactagtcacacgagaggtgaaattttttgtatcaagcataatcccagccatcaataaactagattgaatgcgattaagcttatggtgtttgtcattctggaactgaattaattccgttactaactcactcgcagaactagcaccactctctatataagtcaaaactgcattatttgggaaatctgtatcgcgacgatgatgatcaaccaccacaacctgggtaaatttttcatagaaatccttatccaaagtcaagccaatctttgaatgatctaccatgattaacaacgactggaaagtgaccatcttcatggcttcctcaaccgttaacaaattagaacaattttcatcactcaacttcttgatagcacgtgcaatatctggtgccatttcatctggattatacaccgtataagcattgttcataatattttgagcaaagtactgcatgccgaccgcggatccaagcgcgtccatatctaaattacgatgtcccaccacaaaaacagcatcaaccgatttgagtttatctgatacagcagtcatcatagcacgagtccgcgtacgtgttcgtttaacggaagaagccgagccaccgccaaagaaaagtggctgtttactctcatcattttccttgaccacaacctggtctccaccacgaacctcagccatattgagattttggagcgcaacctgtccgatttggtgatgattttcattaccatacgccaatcccatactcaaagtcaaacctaaatctaactttttagcctcctcgcggaacttatcaataactgaaaacttattctctatcaatttttccaacacagcataatctgtaaagaaatagaatcgatccattgtgccgcgtcggtagtagataccgtaatcatggcaaaattctgaaacaaattgagccaagaaggaattgacttggctaatttgagaatcagttacagcatcctcaagctcgtcatagttatcaactgaaataatccctataacaggacggcttccgatcaaactatttgtcgctgaatactctgtcgacgcatcaaaaaagtaaaataacccttgatcaaaatcaacgttaacagcgtatctcttgcctgaaaagtttgcataaattcgctcctcatccagaccaacgtcaataatttcacgtagttttttttgatcaaactcaccattttcttgagcaaaaatcagctcagcaaagggattaaaccattctacctgattactatctggtcgaactttgataactcccactggcattttatccaagagcatcatcaaaccagaattggcctgattattgagatattcaatctgttctagctcactaaattcataagaatgtttttgataaataaacagcgcaatcaacaccaataggctgatgagtagcgcaaaaactgtactggcaccaattggaaaaaatcggtggacaagagccaccaacccaaataaaatgacacatatcatgacaaagtgaattgtcgaaaatcgaaatcttttcatcactaacctctgcctgccattctaccataaattcagtaaaaaagctacttttcacatgattttaaagtagttgacatatagctgacatacagcgaaaagaacagccttagtgactgtcctttgatttatttttagaaatggaacgactgcgtccttccaagtagaccatgagaatggatatatccgctggattgacaccggaaatccgactagcctggccaatggtttctggtgaaatcagcttgaatttttggcgagcctcggtcgcaatggagtcaatatcatcccagtcaatgtcggctggaatgcgtttttcttccatacgtttcatcttctccacctgatctaaggccttagcaatgtagccctcgtacttgacttctgtttcaatcaattcaatggtcttggcgtccaaatcctctgccgcaggaccgataaaggctaccgcatctgcgtaagtcacatctggacgacgcatgaattccttggcagtcagagcgtctgtcaagggcttgaagcccatggctacgactttttcgttggtttccttgattggcttgagtttgatagactccaaacgcttcatttcattgtcaaattggtttttgtgaatctggaagacctgccagcgttcatcatctaccaagccaacctgacgaccaatctccgtcagtcgcatatcagcattgtcatgacgcagaatcaagcggtattctgcccgactggtcaagaggcggtaaggctccaccgttcccttggttaccaggtcatcaatcataacaccaatgtagccgtcgcttcgtttcaaaatcagctcaggcttgccctgcaccttgagggctgcattgataccagcgacaattccctgacctgctgcttcttcataacctgatgttccgttggtctgacctgctgtaaagagccctgaaatcttcttggtttcaagcgtcgcccgcaactggtgcggcataaccatatcgtactcgatagcatagcccgtccgcatcatctgggcattttccaagcctttaatagagtggatcaagtcctgctgcacatcttctggcagactggttgacagcccttgaacatagatttcgtctgtattgcgaccttctggctctaggaaaagctggtggcgttccttatccgcaaaacggacaatcttgtcctcgattgacggacaataacggggcccaatccccttgacaattcctgaaaacataggtgctcgatgaagattgctgttgataatctcgtggctggtggcgttggtataggtcaaccagcaaggaatttgatccagcaaatagtcctcgtccttggacaagaatgaaaagtggtttggcttttcatcgcctggttgaatctccgtgtcttcgtagttaatggtacgagcattgacacgcggtggcgttcctgtcttgaaccgacctatctcaagtccaagttctttcaggttatccgccagcgtgatagaggcaaggctattgttaggccctgacgaatacttgaggtcaccgatgataatctcaccacgcaaggctgtacccgttgtcaccacaactgccttggctgagaatttctggttggtagccgtgcggacaccgataaccttgccatcctccaccaaaatctcatcaatcatggtttgacgcagggtcagattttcctgacgctccaccgtccgcttcatctctgatgcatactctgccttatctgcctgagcccgcaaggcacgaacagctggccccttgcccatattgagcattttcatctgaatgtaggtcttgtcaatgttgcggcccatttcgccacccagggcatcgatttctcttaccacaatccccttggcagagccaccaatggagggattacaaggcataaaggccaccatatccaagttaatggtcgcaagcagggtcttacagcccatccgactggctgccaatcccgcttctacacccgcatgccccgcaccaatcacgatgacatcatagttttctgcaaatgtgtgtgtcatgttgttctctccttcatgttcatgatatgtttaacttgtccactccagtttggtaattcctgtgtcagaaaagctggtacgacatctaagttgacaaggttgtcaagtgcaatccattcacacggttgtttcaacttcccttcaatcatctccttaggcatttctccaataggctcaacgataaaatgaaactcgatattgtgaaaatctataccttcatgtgtaaactgattttcaacgacaaaaactaattgattgacacgactgtcaatccctaattcttctttgacttcccgaacagccgcatccgctgctacctcattgacctcaaccgcaccaccaatcgtataataacggcccttagcgtccttcgtgagaaatattttcccatcttttataatcaatgcagtggcacggacaccgaagatttgattgtcaattctggtcctaaaatccatttatccttctcttttctaaaatttcgtccagatatggaactaagtttttcttatttttatcgctaggggctaaccatagaaaatctgtatgctcttctgggtcaagaagaatggttttcggttgttcaggaagtgttacttcataaaccagccttgtaaacaccgtctgtttttcttcatcaaactgactatcttcatggataatggtcagattttccttttctatcgaaatacctgtttcctcaaaacactctctcactgcagcatcacggggcaactcattctcctcgacacgaccgcctggaatatcccaatgcagcggaaatacattcggctctccacgcttaatctgcgaacgctgaatcatcaagtgactgtctgcaacagtcagcaagacatgggcaatcaatttaacaggcatggtttcctccgctactttagttgtctttgttcataaaatgctttagttgtccgtcccatttggctagctcggtcttaagaaaggctggattgagatccaatttctctaagtccacaaaagcaatccattcacactggcgaatggaatttccttcttccagataggtgactggctcggacagtggggtaacaagataaagaaattcaatctgatgataggatttctcctgcaaggtgaactgattttcaacgatgaaagctagtggtccaacctccacatcaattccgatttcttctttcatttcccgttgcacagcctcttcggttgtttcaccaagctgaatagctccacccaaagtgtagtatttcccttcaggcgacttaacgagatataacttctcatcttgtaccaccaagcccgtcgcacggacaccgaaaatttggttgtcaactctggttctgaaatccatcttctctccccaatcgcaaaaaatagccaaaactctcgaaaactgcaggacaaaaaagcctacaattcccatgagctttgaccatcatgataattgttacgcttattttagcaaaagatttgtagaatttcaaatctggtgttacgttaacgtttcaatatattctaagccccaagcctcaacagcatccagcaccgaacgaaatttttcgcccatttcagtcaagctatactctacacgaggggggacttctgcatagaccgtgcgactaataatgcgatcctcctccaattgtctaaggtgccttgttaacatggtttgagtaatacctggaattagtcgctgtaattcattgaagcgtttcgttcctgtactgagttggtagataatcaccaatccccacttaccagtcaagactttttgcgttgttgcaaaaggacaaataccatattcactaactttgttcaaaaaaattctcctttatttatcacaatagtatcacttttgataccaacaaatacaaaagtacctacttgtataattgactacttccactataattgtactatatcaaaaaaattggaggacatcaaatgtcaacaaacttagaaatttttaatgcctataacaatgctctcatcgctggtgattttgcagctctttttgaaacaatggcagacgacattatctggcatcaacccggaaatcattcaacatctggtgctaaaattggtaaggaagtactcggagcacatctagcaactttcgccgaaaaaacaaatggaactttcaaagtagtgacaaactgggtatccgataatgatactcttgttgccgctaacgtaacattcctcggtactcgcacagacggtgaagaactaaacatgaatggtatcgatcttttccgtatggaagatggcaaaatcaaggaagtttggctcttctcagccgaccaaaaagccgaagatgctttctggggataagataaatagcttagcacgagagtgctaagctattatttttgattaaatatactgacaagcctctccgtctttataggccatgtcaatcatgccgccaccgaggcattcctgtccgtcatagaaaacaacggcttgtcctggtgtgatagcccgttgtggctctgcaaagatgacttctgccttgtcaccttttaccttgacagtcacttgactgtctggttgacggtagcggaacttagctgtacactcaagtgtgaattcttcaggcatatcacgtgtaaagtgaacttgactagcctgtaaagaagttgacatcaaggactcatgatagaagccttgaccgacatagaggatattttttgacaggtcttttccgacaacaaaccaaggctcattgtcccctccgatttgtcctccgataccaagcccgccccgctgaccgattgtatagtacatgaggcctgtatgctctcccatgtcacgaccgtcaacggtcatcatccgaccgggctgggctggcaaatactgccctaaaaattctttgaagttcttttcaccgataaagcagatgcctgtcgagtctttctttttagcggtcgccaagcctgctcgctctgctatttccctcacctgaggcttttgtaaatggccgagcggaaacatggttttctgcagctgttcctgtgagagttggctaaggaaataggtctggtccttaccattatctgccccacgcagcatatgaacggtgccgtcctcgtcgcgggtaacctgagcgtagtgccctgtcgccacatagtccgcacccaagttcatagcgtaatccaagaaagccttgaacttgatttccttgttacacatgacatctggattgggcgtgcgaccagcccgatactctgctaaaaagtactcaaatacgcggtcccagtactctttttcaaagttgacagagtagtaaggaatgccgatttgatctgccactgcagccacatccttgtaatcttctgttgctgtacagaagccattttcatccgtgtcgtcccagtttttcatgaagatgccgatcacatcgtagccctgctctttgagcaagagagccgtaaccgatgaatccacaccgccactcataccgacaacaacacgggttttagaattgtcaattgacataatcttctcccatcttttcgtagaaataacgatttgaaggtcgtattccaaaatttgattatccaaaaacgattgacgattttgaacaacttgtattataccatacaaaaagggtaagcgatagaattttaacataagaaaacacattcatctaggcatattctctaactggaaaatttgatataatagtaccaagaaaaacgtgaggattactatgacaaacttaaaatttcagtcggtctttgatattattggacctgttatgattggtccatcttctagtcacacagctggggcggtccgaattgggaaaattgtgtcttccatcttcggcgatgagccgacagaggtggaatttcaactctataattcctttgccaagacctatcgtggtcacggtacggatgtagccttggtagcaggtattctgggcatggatacggatgatccccgcattcctgactctcttgatattgcaagagaacgaggcattaaggtttactggcgtgtcaacaaggacagcaataccccacatcccaataccaccagaatcatcataaaaaacgataaaaaatccatctcagccacaggcgtttccatcggtgggggaaacattcaagtaacagagctcaacggcttctctgtcaatctaaatatgaatacgccaactattattattgttcaccaagatgtccctggtatgattgcgaaagtgaccgatgttctttctaagtatgacatcaatatcgcccaaatgaacgtgacacgtgaaaaagctggcgaaaaagccattatgattatcgaagtggatgctcgccaatgtgaaaattctattgcagaaattgaaaaaattccacacctgcacaatgtaaccttcttcaactagaaagagaaagacatgttttatactatcgaagaattagttcagcaagcagacaacttttctggtaatgtagctgaactcatgatcgcgactgaaattgagttgaccggtcgtagccgcgaagaaatattgacaattatgtcaagaaacttgacagttatgaaagcctccatcgtagatggacttactgaaagcaaatccgtatctggtttaacaggaggcgatgctgccaagttagatgcctatatgaaatctggtaaaaccttgtcagattccgctgtcctatccgccgcaagaaatgccatggccgttaatgaattgaatgccaaaatgggcttagtctgtgccactccgacagcaggatctgcaggctgtctaccagctgtgctaggagttgctattgaaaagctcaatttgacagaagaacagcaacttgacttcctatttacagctggagcctttggactagttatcgccaacaacgcctccatctcaggtgcagaaggaggctgtcaggcagaagtcggatctgcctctgctatgtctgccgcagccctgacactggcagcaggtggaactccctaccaagccagccaagccatctgctttgtcataaaaaatatgctgggtctgatttgcgatcccgtcgctggtctggtagaagtcccttgtgtcagacgtaatgcaatgggagcaagctacgccatggtagctgccgatatggcactggcaggaattgaatcaaaaatccctgttgatgaagtcatcaacgctatgtaccaagtgggatctgccctaccaaccgccttccgtgaaactgccgaaggaggccttgcagctacaccgacgggtcgtcgccttgctcaagaaatttttggagaagattgacaataatgtaaaccaaaaaggaccctaacggtcctttttcttattatggcttcgggctagttttctcatagagaaaaacaagaaaactactacctatgctggtggctagcaaggctttgagcttctatttttttcctgttataatctaatttgtcaagttaaataaaggaggagtaaactagtccagtggactagtttagcatggttaaaaccgttacagtttatcacataccaaatgtatgtcactcctaagtaccgcagaaaatccatttactaaaaaattagacgggacttaattgatattttccatcacctatgtccatacagcgtggaaatcaaaagttttgggctagaggctactattcagtaccgttggactgaacgaaaaagcagttgtgaaatacattcgtgagacagaaaaagtctagcatcgtgctagacctcttctaatttatcttagtaccaaccatttgccaaccagaaagccttggctgcagaccatgaaccatagcgactagcaacataagcatctgctacacgctcttggttttctggtgagtaatcaccattcaagtaagtatttgtcaactggtaacgaccaatgtagataccgttacgggcatcatagctaccgcttgattccttcattgcaatccattcttttgctgctgcatcttcagcactcaaatttgaagaataggtgctagtcgttactgttgcggtagaagttgatgttgattgagtttgttcaactgaactctctactgccttcactgtcacatcacccaattcgataacttgaccgacatggataaaatctaagttggtaatcttattctgctctgctaatttttcaacagtagtattgtatgtttcagcaatttcagacagggtatcaccagactttacagtataggtttctgcactgactacacccgcagttaaaagggagattcccgctaccaaaccagcaatagttgtttttaagtttttctttaatgtaatgttcataatagtcacattcctttctgtcatgtgtctatcataccctctaactattacttagactttgtgaaattgttacaaatattacagacaaattgagattagacaataaaaacgctatttctagcgttttttacttattttttcaatataaataagagtccggctaaagctaacataactaaaattgctaacgtatctgctaacttccattccaaaatccggtacttggttctcccatcgccgccttgatacccacgcgcctccatcgccgttgcaagagcatctgccctcttaaaacttgatgcgaataacggaatcaaaataggaataactgactttaccttctgaataagatttccctcattaaagtccactccacgagctctctgagcattcataatccgagtggtatcatccatcaaggtcggtacaaaacgcaagctcatggacaacatcaaaccaatttcatgcacaggaactttaaatttcttcaaaggtgcaagccccgactcaataccatcagccaagctaaggggtgtcgtcgtcaaggtcaatagggttgagaagaaaataatcaaaacaaagcgaacaaaaataatcgccgcctgttgcaacccttctacagataatttaaaaatccaaaactcccatagaatggtcgctccaggtgtaaagaaaacctgaaagaaagttgtaaatagaataattcctatcatcggtttcaaaccattaataaaaaatgataagcgaatacgtgataaaacaaccattcctaaaacaaatgctatcaacaaggcattggtgaccaaattattggcccaaaaaatcatcaatagaaatccaaacattgctaaaagcttacttcttggatccaagcgatgaataattgaatccccaggaatatagcgacctaaaattaatttatccatgtgtcaccatccccgtaaattcttcaattgtaataggaagacgttcaaatacaaagcctcttctctccaaattagctgcaaacttagtaatcttaggcactcccaactgaatactctctaaaaaatctacctcttgaaaaatatcgactggtttaccagaacggaccagctttcccttttccataatgtaaacaaaatcagcatagttagccacatcgtccatcaaatgagttaccaaaacgattgtcatgcctgattcatgaagctttttgaaaatatccatcaattcctgacgacccgcaggatccaatccagccgttggttcatccaaaactaagatacttggttccattgccagaatcccagcaatagctacccgacgcatttgaccaccagatagttcaaaaggactacgctcaaacaagctttcatcaattccaaccaaggccaacttttcacgcgcaatcgtttcagcctcttcctgagaaactccgaaattttgtggaccaaaagcaacgtcttttaagaccgtttcatcaaacacttgactttcaggaaattggaacaccaaccccactttcttcctgacttgcttaatatccttattttcagacgtcgctgtaatcacaacatcatcaataactactcttccttctgttggtacatttaatccattcaagagttgtaaaatcgttgatttgcccgaacccgtatgcccaataagggccgtgtaagagccatcaacaatctccaaatccacaccaaaaagcgcacgcccctcaaaaggagtgccagcttgataggtatagcttacttcttggagatcaattcccataaagtttcctctaattcttcctctgtaaaatagcggagcggtaaatcaagtccagtctggcgcaaagatgaagccagttctgtcgtaaacggtctatccaagtctaaatctaccaaatcttctcgcataaatagttcatttggagtgctaattgattcaacctgtccatttttcatcacgataactcgatcactcaatgcaacctcatccaaatcatgtgttatagagataaccgtcataccatgacgctccttaatttcacggacaatcttaatcaagtcgagacgaccttctggatccaacatagacgtagcctcatccaaaataataatttttggacgcaaggcaaccactccagcaatcgccaccctctgcttctgaccaccagataaacgagcaggctcacgtgttttgaaatcagtcattccaactaattccaaagcttcgtcaactcgactacgcatctcctccaaagggattccctgattctctaaaccaaatgcaacatcatcttcaactgtagcgcctacaaattggttatctggattttgaaaaaccataccaatcaagcgtcgcttatcccatacattatcaatggttaaggcatcaccgtcaatataaatatcacctgattcagcttccaacaaaccatcaatcaaacgaactgttgttgatttacccgaaccattatgaccaataatagatagccactctccctgtttcacgtgaaacgaaacatcatttagagtatattgctcatcctcttggttgtatttatattttaaattttttacttcaataatattcatcatttaaatgtatctttaaacaagaaggacgcacccttgaaataatcatagccagaatatagggtgaagaaaagtgcaatatagagtgttatttgccccacgacgttccagtgtaagagcaggaaaataactgcaaacatctgtgaaaatgttttgatttttcctggcatagccgcagctagaactgttcctccattttccaccaagagtagacgaagacctgtcactgccaattcacgacaaataataattgcaactacccaagctggagcaaagccaagctctacaagcatgataaatgctgtcatcaccaaaatcttatctgccatcggatccgcaaattttccaaagtttgttacaacctgccatttacgagccaagtagccgtctagataatccgtaatactagctaatgcaaaaataagtgctgctaagacatgactaattgttgaattccaaacggtcagtaacaagataaaaattggaattaccaaaatcctacctatcgtcaatgcattgggaatattttcttttttcatataaaacctttattgttcaaaatttattgtaattgagcctgtatctgctgtcagagctgatagttctagcttttgaccacctacacttacctcaacccctttaacaacaccaagaataagtgtagtagaagtcactccttcttcaatagtagtagttactgttggattatcaggtgttagtgtaacgcccccctctaacaaggtgtcagaaaggctgatccaactcgttgtattttttgctgttacagttacttctactggataagtcactgttttaagggtcgcaacaatgttagaacctgatcctgaaatagtcacattttctgtagcggaactacttgaactcgttgaatttgactgcgcctgctcagtagaactcgtctctgtgccactacttgcttcagatacagattgctcaactatactatatgacgttgtagtaggcgtaatagatgctctatttttgagcctgctatgaacaatataaatcacaaaaataataatcaaccccgtcgcaagtaataagtaaatcaacggaagataagagttctttttacgtttacgaaccttatagcttcttttcaattctgaagagcgtagttcttcttctccatcttcataatatttcactaaactattggtctcgtaagcatccagtagaacatctgcatctaattccaaagcctcagcgtatgcttttaaaatagactgaacaacatctgagtttgcaataaaatcaaaatcattgtactcaagtgcctgcaaatatttagcttggatttttgttatccgttgcaagtcaacaaatgtccaaccccgtccttctctggctgttctaagtacttcccctatactcttttgtctcataataccctctctctatcgctcatcatgtacagtatactattctaacaaaattccaaggaaatttcgacgggttgcgcccacttattttggaaaaatcgtgaaatctgtcatatcacagtgatcaataaagcgacgacctgcctctctgatgtcatctaactgaagactttgtatcatttgaggtatatcaaaaacattttcatattctgaatactgagaaacaaagtgactagctgtaaactcaagagaatttaagctacgaataaaatctccatacatctcgtttttcaacaattgtaaatgatcctctgtcacatctgcatcatcctcaaatttcctaagtgctttcatcagtatactagaaagcgtaatgggttcttgagtatctcccgagataatcaaatagtggtattcaggtgtaacctctaattggaactggaaagaagaatcaatttttccctgctcgtataactgttgatagcgttttgaagtccaaccaaacaacatggcaaataaaaattgtaaactaagccgatatttctgaatagtctccttatcaacctcgtcatttccccgtaaaccaacagccaattttggggtagatacttcaaattgttctgagagatgttcctgtatcggcaacttttggatacctgccaattcaaacgactgagctggattatccatctgagctacttgataacttgaaatttgtttccaaactgcctctaaatcaaaattaccaataacgaataaattcatgttacttggatgataaaacacatcaaaattctcatgtaaatcatccgcagtaattgcagcaattgattcaactgtccctgctatatcataggccaaaggactttctggataaagcgatgatagaattcccgtaaacaagcgataatctgcatcatcttgatacatctcgatttcttgttcaataatcccctgttctctttctacattgtcttctgtaaaatacggttctcgaacaaaagattgtaaaagtgatagagactccaatactttctgagtcgttgaaaataagtaactagtctgtctaaaactggtataagcatttgcgcttgctcccaatttagcaaactcattcataatatcctcttcattctcagtttcaaacagcttatgttctaaaaaatgtgcaatccctgcaggataaacaacactattaccattagccaatgtaaatcgagtatgaatacccccaaaatttgtcgttagaattccatatgtctcatggaaatctactttaggaagcaaaataactgtcaacccattgtcaactttcccataaaagacagattctttcatgtaaggatacttcttctcaactaacttcattcttctgtcccctccataaagtaaacagcctgtaaattaatcatctgtcctacttgaatgacatcgtctattgataccgatttgatagcctcaatccaatctaaccaacttaaatttctatttcctaaggtaacttgattatatacttgttctatcaaattattctgcctatcttgagccaaggttgctgaatgaatcaacatgttttttgtcaactctaattcttcttctgtaaacttaccacattttaaatcaagtagttgtttactaattaacttcattaccctgagtctattttcacggctaattccagcatagacctttagcattcctgaaaaaatagagacctgactaccaattgtataggccaaactttctttctcacgaacattcataaataacttcgaatgggagaaagcacccagtagaccattaaataccatcaaagccggatagtttacatcgttgtaaaccacctgtaaatgatatgccaattccaaaatggactgccttgcctgtttacgctcgattttttcttgcgtgatatttgagtattcctgatgatattctaactctaattttggatttctataagtaaaaccaaaatcttcaagttttctttttacttgttctctgtcaaccttccctaagacaaatatatcaattttatccatacgcaacatattccgataaatctgaaaggttgattctgctgtttctttttcaaccaaatcaagcctaccgacgcgtggaatttgaagagagggatctttataaaaaagcttactcatttcaacatctacatgataaaaattatcttctatctctgactgaagaaaattgattaaattcgttttttcaacctcgaaaatctggctatcaaatcctcgcccctttttcagtggtctaaatatacatgtgtataaaaaatcaagaatctccactgtaatatcctcattttctggtaagtgacgaggactgacatatgaaattgtcacatctacacagtgcaccctaccacgtttcgaaactgaggtcgagaactgagcaccatacaattctgccaatcttctccgaacagcctgagcagtctgaaattcttggttacccatttcaaaaatatttgcaactaacacacgaccagcaactgtagcctcactcatttcagctgcaaagcgaatacgtatacgatttgtcgtaaactgatctgtatcaataaaatgaagatctactccctcttgtaatttcatcgtcttcctctttcaaacattgtaccttccattataccattttgtgatataatattctgtaacgaggtgacttatggaatttaaattatttgatgactacatcacattacaagcattgttaaaaacgactggtattctccattcaggaggtgccattaaaggtttcttagaagaaaataccattcttttcaatggagaggatgaaaaaagacgcggtaaaaaaatccgtgtcggagatgttatcacactcccagaccacaacaccagcatcacaatcgtcgctcctagtgcagaggaaatcaaacagcaccaagaggatcaagctgaaaaagaacgtgtggctgcaatcgttaaaaagttaaatcaagaaaataaaaataataagaaacaggtaaaaactcctaaaaaagcaactaaaaagactgaaagaaaacctgttcgtttccctggtatgtagacatgtggctagaacgattagagttacaacattttcgcaattacaaccaattagatattgagttccacaaagggctcaatgtctttttaggcgaaaacgcccaaggaaaaaccaatattctagaatctatctatgttttagccttaacacgaagtcatcgaacacggacagataaggacctactacagtttcaagaaaaggaattatctatttctggtttactccatcgcacaagcggtaaagttccccttgacattcacttgacagacaagggacgagtgaccaaggtcaaccatctcaaacaagccaagctttccaactatatcggccacatgaatgttgttctcttcgcccctgaagatttacagctgataaaaggtgcgcctgctttgagaagaaagttcatcgatgtcgagctcgggcaaatcaagccactctatctctctgacctatcgaattataaccacgttttaaaacaaagaaatacttacctcaaatctacagataagattgatgagaacttcctatctgtgttagatcagcaacttgctgaatatggtagtcgtgttatccaacatcgtattgactttctaaagaaattagaggaattcggaaatagaaaagttcaagaaatatctggcaatcgggaagaattgacaatcgaataccagacctcaatcgaattgacagatgatgtcaatttaattgacaaattcttgacggaactagaaaagtctcgtaaacgtgatttatttaagaaaaatacaggagttggaccacatcgagatgatgtagctttctttataaatggaatgaatgcccattatgctagccaaggtcagcaccgcagtctcgttctgtcactcaaactagctgaaattgagctgatgaaagaagtcacacgagagtacccaattctactcttagatgatgttatgagtgagctggataataatcgtcaaatcaaactattagaaactattacagatacgattcaaacatttattacaacgacatctttagaccatttacataagctacctgatagtttaaaaatcttccatattgagtctggtaaggttactgagtcagaataagattgtttacactatcgtcaataaagtttacaaaaaagtaaagaccctgtcaagagggtcttgcagaacgtagacaaactcctaaaaatataaaaaattgaagaagtttgcgaaagatagcaagttattaaactcttagaaatattgatatttcggcgtttctgagagtttttttattttcaatataaagaaaaaaagattgaagaaaattgtccaaaatggactttttcttcaatctgaaagaccctgccaagagggtcttgtttttgttttactgaactgaatagtttggagcttcgtttgtgatttgaacatcgtgtggatggctttctttcaaaccagcacctgacatttcgatgaattgtgcattttcatgcaattcagtcaagttaccagcacctacatagcccatacctgagcgaagtccaccaaccatttggaaaatcatatctgcaacagaacctttataggctacacgtccttcaattccttctggaacaagtttgttggcttcattgacagatgcttggaagtaacggtcttttgaaccttgtttcatggcagcgatagagcccataccacgataggtcttgaacttacgaccttggaagatttctgtctcacctggtgcttcatcagttcctgcaaacatagaaccaagcataacggcatgaccaccagcggcaagtgccttgacaatatctcctgaatacttgataccaccatcagcgataatcgttttaccatattcacgcgcaacaccagctgcatcatagatagctgtcacttgtggtacaccgacacctgcgataacacgtgttgtacagattgaacctggtccaataccgaccttcacaacatcaacaccagcttcataaagagcacgagctccttcagctgtggcaatgttgccggcaatcaaggtacgagttgggaagtggtcacggatttctttaatcttgcgaagaacgcctgctgagtgaccgtgagctgtatcgatgacaatcgcgtctgcacccgcttcaaaaagggcttctgcacgttcaaaagtatcagatgtaacaccaacagcacccgcaaccaagagacgaccaaattcatccttcgcagcatttgggaactcaatcactttctcaatatctttgatggtaatcaagcctgacaaacgaccattttcatcaaccaatggcaatttttcaatacgatgcttgtgaagaatagcctccgcagtcgcaagatctgttccaactggcgctgtcaccaattcatcgcttgtcatgttggtcgaaattggctgtgagtaatctgaaatgaaacgcatatcgcggttggtgataataccgaccaacttacgattttccaatgtttcaacgattggcacaccggaaatacgataagtagccatcaatttctcagcttcagcaatggtgtgttctggtgttaagaagaatggatcgataatgacaccattttcagaacgttttaccttacgcacctcatctgcctgctccgcgatagacatgttcttatggatgacgcccaaaccacctgcacgcgccatagcgatagccattttgctatctgttactgtatccatggcagcagaaataatcggaagattaagggtcaaatttggtgctaattgtgtttttaaatcaatatcatgtggtaatacatgactttcagccggaataagtaatacatcgtcgaaagtaaagccttttttcaaaaatttagtgtcccagtttgacattttcttcctcttttcttatttaatatgtagcatgattgctatttgtattttaattatgataacattttgaaatcatttgtcaatcattattcgctttaatatcatcattcctaaaaattcagaaaattctattcagtcttatacataaaattcgaacgtttgttttttgctacgtcgtaaaacaaatgaaaaaaacaacattttctcaacattgctctttcattgttaaccttatttaaaatagttgattcccatagcagatttcacttggtcaagagttttcgcagcaacttggcgagctctttggctacctgcttccaacattgcatagacctgtcccatatcctgtgcaaactccagacggcgttcacggattggtcctaattctctctctaaaatgtccagcaaataacgtttggtcttcacatcgcccaaaccaccacgttgatagtgctccttcatagcctcaatctcagccttatcttcttcgcgcccaaagacgtcaagatagtggaaaaccatgtttccttcaatcttacctgggtcttcaacacggatgtggttgggatcagtgtacatggacatgactttcttcttgagcgtatccatgtcatctgccagataaataccatttccaagtgatttagacatcttggcattgccgtccaaacctggcaagcgaccagctgcctcattttcaggataaatgccctccggctctaccaaaatatcagtctggtaagcatggttaaagctacgaacgatttcacgagtctgctcaatcataggtttctggtcatttcctactggaacaaagtttgccttgaaggctgtaatatccgccgcttgtgacacaggatagaccaaaaaaccagctggaattccttcgccaaatcccttctgagcaatctcagtcttcactgtaggattgcgttctagacgtgcaacagataccaagttcatgtagtacatggtcaactctgccaattcaggaatttgactctggatgaaaatcgttgtcttagctggatcaagtcctgccgctagataatctagtgctacgtttccaacggattcaacaatcttttgcggttcctttgcatgatctgtcaacgcttgttggtctgctaaaaagacaaaaagttcatgttgacctgcatcctgtaataaaacacgatttttcaacgaaccaacataatgtccaatatgtaatttgcctgttggacggtctcctgttaggataatcggtttactcataaaatgttctccttttacataataaaagcccacgcacagaaaactgtgcgagggcgtcaaggacacggtgccacctcacttataagcattaaataagcttacatctttttgcacataaggcctgctagccgaatccttatttattcagattctattcactcagtccattcataagcgactcttgtttgtttacaccaaccacaaactctctaaaaattatccacttactactcttctgattgattcctattataaccgcaaaaaattagaaagtcaagctgacaaagccttgacgatactgtctaaattagggataatagaaattgcttttataacactaaccaaggagaatatatgaaagaacgtataaaggactttatctctgtcacactcggatcagttgtcatggccattggatttaacagtttttttctagagaataatatcgtatctggtggtgtcggaggtttagcaatcgcactcaatgctcttctgaggtggagtccgtctgattttgtcctctactgtaacatccctttattaatcatctgttggtttttcttaggaaaatctgtatttatcaaaactgtctatggtgctatcatctatcctctttgcatcaagttgacagcaggtttacccaacttgacagaaaatcctctcctagctgctattttcggtggaattatcctaggttttggacttgggcttgtcttccttggaaattcttctactggtggaacaggtattcttattcaatttattcacaagtacacccctttatcattaggtctgacaatggctattattgatggtattatcgttggtcttggatttgttgccttcgatactgatactgttatgtactcgattattgccctaatgaccattacttatattgtcaaccgcatgatgtctggtacccaatcttctcgaaatgtcatgattatttctcaaaaatcagaagaaattaaagactatattactaaagttgctgatcgcggtgtgacagaacttccaattatcggtggctttacaggagttgacaagcgcatgttgatgactaccatctctattccagaaatgcagaaacttgagacagcggtattagaaattgatgaaactgcctttatggttgttatgcctgcgagtcaggtgcgtggacgtggcttcagtcttcaaaaagaccataaacattatgatgaagatattttgattccaatgtaattcattgaaaattcaagttctttctagtacaataaaactaatagacagaaatagaggagaaactatgcttacagtatcagacgtgtcgcttcgctttagcgatcgcaaattatttgacgatgtcaatatcaaatttacagcaggaaatacctacggtttgattggtgcaaacggggccggtaaatctacatttttgaaaattcttgctggtgacatcgagccatcaacaggtcatatttcacttggaccagacgaacgcctttctgtactacgtcagaaccatttcgactatgaagacgaacgcgtcattgacgtagttatcatggggaatgagcaactttacagcatcatgaaagaaaaagatgctatttacatgaaggaagatttttctgatgaagatggtgttcgtgctgctgaattagaaggtgagtttgctgaacttggtggctgggaagctgaaagtgaagcttctcaattgctccaaaacctcaacatttcagaagacctccactaccaaaacatgagcgaattgaccaacggtgagaaggttaaggtcctcttggctaaggcactttttggtaaaccagatgttcttcttttggacgagccaaccaacggtctggacatccaatctatcaactggctcgaagatttcttgattgactttgaaaatacggttatcgtcgtgtcacacgaccgccacttcttaaacaaagtatgtacccatatggccgaccttgacttcggtaaaatcaagattttcgttggtaactatgacttctggaaacaatctagcgaactagcagctaaactacaagctgaccgtaatgcaaaagcagaagaaaaaatcaaagaactacaagaattcgttgcccgtttctctgctaatgcttctaagtctaagcaagctacttcacgtaagaaaatgttggacaaaatcgagttggaagaaatcattccttctagccgtaagtatccatttatcaacttcaaatcagaacgtgaaatcggtaatgacctcttaacagttgaaaacttgaaagttgttattgatggtgaaacgattcttgacaatatcagctttatcctgcgcccaggtgacaagactgctcttattggtcaaaacgacatccaaacaactgctctcattcgtgctcttatgggcgatattgaatatgaaggtactgtcaagtggggtgtcactactagtcaatcctacttaccaaaagacaatactcgtgactttgatacaaacgaatctatccttgattggctccgtcaatttgccagcaaggaagaagatgacaataccttcttgcgcggtttcttgggacgtatgctcttctcgggtgatgaggttaacaaacctgtaaacgtcttgtcagggggcgaaaaagtgcgcgtgatgttgtcaaaactcatgctcctcaagtcaaatgtcttggtcttagatgatccaaccaaccacttggacttggaatcaatttccagtctgaacgatggtttgaaagcttttaaagagtccatcatctttgccagccatgaccacgaatttattcaaactttagcaaaccatatcatcgtcatttctaaaaacggtgttatcgaccgaatcgacgaaacttatgatgaattcttggaaaatgctgaagtacaagcaaaagtacaagaactttggaaagcataataaaaagaggctgggacttttgcccagcctctcttctcagagttcgtgtcaacatctcagcgcagtggttgattgccagatttgttcgtgtttcacactccaaatctggccattacgactgttgcgaacaaagttcgccttatctccaacctcaaactgtctcccagacagtttgagctgtgcgggggtgggagtgaaacagtctgggaatagactgtttcagctcaacaactagaaataaagacttgttgacgaactcttttttgaccggtcaagttctttcccacttccttttcttttaaatctatgaaaaaaatatttacaaaaacatccatttattatctcttatctttccttattccgctgactattatttctatcgtcttagcatttcaaggaatctggtggggaagtgatacaacaatattggccagtgatggtttccatcagtatgttatttttaatcaaacattacgaaatactttacacggagacggctctttattttacacattttcaagtggtttaggactcaatttttatgctctatcctcctattacctaggttcattcctatctccaattgtctttttctttgatttacaatccatgcctgacgctatctaccttgtcactattgtcaaatttggattgactgggttgtcaacttatttcagtctaaagggtatccataaaaatttgaaagaagaatgggcactattactcgctactagtttttctctgatgagttttagtacaagtcaattagaaataaacaactggctagacgtttttatactcctcccactcgttcttcttggattgcatcgattattaaaaaaacagggtccgattctctactacataacattaacatgcttgtttatccaaaactattacttcggttatatggtggctatttttctaacattatggacattggttcaattatcatggatagatagtcagagaatcaaaagatttatcaactttacaatagtgtcaattttatctgctctaagcagcatgttcatgttgttaccaacctacttggatttaaaaactcatggtgagacatttacaaaaattgtcaacctaaaaaccgaagactcttggtatctggacttctttgcaaaaaacttagttggtagctttgatacaacaaaattcggttctattcccatgatctctgttggtctcgttccattaatactcgctttattattctttacattaaaagaaataaaaccaactgtcaaactctcctatgctctattctttacattcattatttcaagtttctacctacaaccactcaatcttttttggcaaggtatgcatgcgccaaacatgttcctctatcgttatgcatgggctctatcaataaccgttatctatttagcagcagagacattggtacgactacgtcaagtaagtattaaaaattttactctgattgtttcatttttactcatttgctttacttctacctttatttttagagatcattatgagtttctaacggatgtaaatttcctactcacactagaatttctaatagcctacttcattctttttgtagcaatgattcgctataaatcatccttaaaatggattaatattgttttattgttcttcactttcttagaacttggattacatagtcattatcaggttcaggggatttctgatgaatggcattttcctagccgatcaaactatgaagaaaaattgacagatattgacagtattgtaaagtctacaaagactacaactgattcattttatcgtatagaacgtctattaccacaaactggcaatgatagcatgaaattcaattacaacggtatttctcaattctcctccattcgaaatcgtgcttccagctcagtactagataagctcggtttccgttcagatggtaccaatttgaatcttcgctatcagaataatacaatcattgctgatagcctattcggagtcaaatataatttagctactacggacccaaataagtttggtttcacactgaatcagagtcagtctactattaatctttacgaaaatagttttaatctagggttagccctattgactgaagggatttacaaagatgtcaattttacaaatctgactctcgataatcaaacaaattttcttaatcaactaacagggctatctcaaaaatactaccacactttatcagatgttgtttcacaaaatacagttgaactgagcaatcgaatgactgtcaacaaagtggacaatgaggatgctgcaaaagcaactttcttagtaaatatacctgcaaatagccaagtatacttaaatttgccaaatttaacattctcaaatgagaatcaaaaaaaagttgtcattactgtcaacaatcagtcaagtgagtttacactagataatgctttctctttcttcaatgtggggagctttactacagatgtacaggttcaagtcaatgtatattttcctgaaaataatcaagtttcttttgataaaccacaattttatcgattggacttattagctttccaacaggctatttccattctccaagaaaaacaagtagtaacaaaaactgatggtaataaagtaactgttgattttgtaaccgataaagaatcctcactcctccttactttaccctatgataaaggatggaatgcaaccattgatggtaaacctatcaaaatccaaaaagcgcaagatggttttatgaaagtggatgtaagtccaggtcaaactaaactagttttaacctttgtaccaaatggtttctatctaggtttactgatttcttttggtgcagtttttgtatttttctcctatcaattcattggatactattattctaagaaccgagaatactaaactttctcggttttttcttgtaaaaaacaaaaaaccttgatttctcaaggtttcctatgctttatctactccgccaacagggctcgaacctgtgacatcatgattaacagtcatgcgctctaccaactgagctatggcggaagaaatagtccgtacgggattcgaacccgtgttaccgccgtgaaaaggcggtgtcttaaccccttgaccaacggaccatttttagaacaataactagtataatacatgtgactttgtttgtcaatacattttttgattttttattgtattgacagagtgctttgtttaatgtaaaataaaatggttaaggttccatagctcagctggatagagcattcgccttctaagcgaacggtcgcaggttcgaatcctgctggaatcatttagacctacctcgagtaggtcttttttcttgccataattcataattaatatataacactggcaaaatcagaccaataagggcatattcttcaaattggaaggataggtgagtagatatgatgacacctagcataaaccctataatggtcaataagatgtttctacctgtttttctaagttctgaatctttttcaataactcctttaaaccagagataagcagcatttttgacattccctgtcatcatcacattggcatacggagcacctcgtaaccttctaaatgtttctacttgaatagaggctacgaaggctagactagcaattgtaaaagacgcaggcattataggtgagagaatgatagttagtaaaataagaactaacatcattacactactaccaaagtgccaagaccatgtttgtttttcaaaataccttcttgctaagtaggtaaaaaattgtccgaatacaaaaaataaaatgggaatggaaaaattaactacctgcgcaaaatcacctttagctaaaaaataagctagggaaataacatttccagattgtacgccagcaaagcgaccaccctgagtcacaaaagtaaaggcatttaaataaccactgataaacgttaatgaacaagcaattctcaatccctcaaaaacacgatactctttttgattcattttcactccttgtttcacgtgaaactacttatgatatgggcttccctgctgaatcataaatgcacgataaatctgctcgatgagaactaatttcattagttgatggggaagtgtcaactgtccaaaactcatcaacaaattagctctttttttaatacaagaatcgagacccaaactaccaccgatgataaaagttatatctgaatacccatttactgcaatgtcagatatcctttgactaaattcttccgatggaaattgtttcccttctatcgctaaggcaatgacaaaatctcgctctccaattttagacataattctatcggcttctttttttaatatttgttcattctctgcctgactggctttatctggtgttttttcatcaggaagctcaatcatatccaacttagtaaatcgtcccaatcgtttactatattctgcaataccttctttgaggtacttttctttcaattttccaacggtaatcaattttattttcataaaataattgtaacatatccacaagcatacgacagaaaatatttttagaaaatcaggatatggctacagtttttcacataattcacagagttatccacaggttgtggattgatttttgaaaactttaagttataattaagaaagaaatagtactcttaaggaaaattaaagaaatggaaaggattccttatatgaaaaaatatttgaaatttgcgattttatttgtaattggattttttgggggtcttatcggggccttgtcagcctctttcttccagccacaggtgcaacaagcaaattctgctatcactagtgtcagcaatgttcaatataataatgaaacttccaccacaaaagctgtagagaaagtacaaaatgctgttgtgtctgttattaattaccaaaaatcagccaacaatagtcttggtgttatctttggaaatattgaatcatctgacgaactagctgttgctggagaggggtctggggttatctataaaaaatatggtcaatatgcctatattgtgacaaatacgcatgttattaataacgcagaaaagattgatatccttttagcatctggagaaaaaattagcggtgaacttgttggttccgatacatattctgatatagctgttataaaaatatcagcagataaagtcactgctgttgctgaatttgctgattccgatacaattaaagttggagaaactgctatcgcaattggtagtcctctaggtagcgtctacgccaatacagttacccagggtattatttctagcttaagtcggacagttacttcacaatcaaaagatggacaaacaatctcaactaacgctattcaaactgatacagctatcaaccctggaaactctggcggaccgttaatcaatacccaaggacaagtgataggcattacctctagcaaaattacctcaagttctgcaaatagctcaggcgtggctgtagaagggttgggatttgctattcctgcaaatgatgccgtagctattatcaatcagcttgaaaaaactggacaagttagccgacctgctcttggagttcatatggttaacttgacgaccttgtcaactagtcaattagaaaaagctggattatcaaatacggaattaacatccggtgtagtaattgtctctacacaaagtgggctacctgcagatggaaaattagaaacttttgatgttattactgagattgacggagaagctattcaaaataagagtgacctccagagcgctctctacaaacatcaaattggagatacaatcactgtaacttattaccgcaataatcagaaacaaactgttgacattaagttgacacattctacagaagaacttagcgaataattgacaaatgagactttacacaattgtaaagtctcattttttttgctagaataaggatatatggaagaattacgtacactaaatatttcagaaatccatcccaatccctatcagccaagaattcattttgatgaaaaggagctacttgagctcgctcaatctattaaggaaaatggcttaattcaaccgattattgtaagaaaatcttctattatcggatacgaattattagctggagaaagaaggttgcgagccagtcaattagctggactgactacaataccagcagtggtaaaagaactgactgatgatgatttactctatcaggctatcatagagaatctgcagcgttctaacttaaatccgatagaagaagcagcctcttatcaaaaattgattagtagagggttaacacatgatgaagttgctcaaatcatgggaaaatcaagaccatatatcagtaatttattgcgcctactaaatctatcatctcagactaaacaagctgtagaagaaggaaaaatttcacaagggcacgcgcgacaattggtgtcattttcagaagaaaagcaagccgaatgggttcaactcattttatcaaaggatttaagtgtgcgtacgcttgaaaaattaatagctgcaaataagaaaaaacacactaagcttaaacaacgcgaccaatttttaaaagaacaggaagattcactcagtaaaactcttggaacagctacaaaaattatcaagaagaaaaacgggagcggagaaattcggattagctttaatgacctcgatgaattcgaaagaattatcaacaattttaaatagacttgtttacaatttatttttataaacactcttttccacactaaaatcattacaaaaagtcaggaccagcaagggttctgacttttattcacatcttgtggaaaacttttcttaacagtgtggattttaaaaattatctgtggaaaacttttgttttttatggtacactattctaacgaatataatgtgaaagggggaaaat

(The sequence listing continues in the following parts.)

We claim:

1. An immunogenic composition, consisting essentially of inactivated bacterial antigens from *Streptococcus suis, Haemophilus parasuis, Actinobacillus suis*, or a combination thereof, a polyacrylic acid adjuvant, an oil-in-water adjuvant, and a surfactant.

2. The composition of claim 1, wherein the inactivated bacterial antigens are antigens from *Streptococcus suis, Haemophilus parasuis*, and *Actinobacillus suis*.

3. A method, comprising intranasally administering to a swine, a composition according to claim 1.

4. A method of inducing an immune response in a swine, comprising administrating the composition of claim 1 to a mucosal membrane in the swine.

5. The method of claim 4, wherein inducing an immune response comprises inducing an IgA response in the swine.

6. The composition of claim 1, wherein the surfactant is a detergent.

* * * * *